US011801227B2

(12) United States Patent
Benenato et al.

(10) Patent No.: US 11,801,227 B2
(45) Date of Patent: Oct. 31, 2023

(54) POLYNUCLEOTIDES ENCODING CYSTIC FIBROSIS TRANSMEMBRANE CONDUCTANCE REGULATOR FOR THE TREATMENT OF CYSTIC FIBROSIS

(71) Applicant: ModernaTX, Inc., Cambridge, MA (US)

(72) Inventors: Kerry Benenato, Cambridge, MA (US); Stephen Hoge, Cambridge, MA (US); Iain McFadyen, Medford, MA (US); Vladimir Presnyak, Manchester, NH (US); Paolo Martini, Boston, MA (US); Ellalahewage Sathyajith Kumarasinghe, Cambridge, MA (US)

(73) Assignee: ModernaTX, Inc., Cambridge, MA (US)

( * ) Notice: Subject to any disclaimer, the term of this patent is extended or adjusted under 35 U.S.C. 154(b) by 658 days.

(21) Appl. No.: 16/302,370

(22) PCT Filed: May 18, 2017

(86) PCT No.: PCT/US2017/033419
§ 371 (c)(1),
(2) Date: Nov. 16, 2018

(87) PCT Pub. No.: WO2017/201347
PCT Pub. Date: Nov. 23, 2017

(65) Prior Publication Data
US 2019/0298658 A1    Oct. 3, 2019

Related U.S. Application Data

(60) Provisional application No. 62/338,492, filed on May 18, 2016.

(51) Int. Cl.
| | | |
|---|---|---|
| A61K 38/18 | (2006.01) |
| A61K 9/51 | (2006.01) |
| A61K 9/00 | (2006.01) |
| A61K 9/127 | (2006.01) |
| C07K 14/705 | (2006.01) |
| C07K 14/47 | (2006.01) |
| A61P 11/00 | (2006.01) |
| A61K 38/17 | (2006.01) |
| C12N 15/88 | (2006.01) |

(52) U.S. Cl.
CPC .......... *A61K 9/5123* (2013.01); *A61K 9/0043* (2013.01); *A61K 9/0053* (2013.01); *A61K 9/0073* (2013.01); *A61K 38/177* (2013.01); *A61P 11/00* (2018.01); *C07K 14/47* (2013.01); *C12N 15/88* (2013.01); *A61K 9/1271* (2013.01)

(58) Field of Classification Search
CPC .. A61K 9/5123; A61K 9/0043; A61K 9/0053; A61K 9/0073; A61K 38/177; A61K 9/1271; A61P 11/00; C07K 14/47; C12N 15/88
See application file for complete search history.

(56) References Cited

U.S. PATENT DOCUMENTS

| | | |
|---|---|---|
| 8,691,966 B2 | 4/2014 | Kariko et al. |
| 9,095,552 B2 | 8/2015 | Chakraborty et al. |
| 9,107,886 B2 | 8/2015 | Chakraborty et al. |
| 9,114,113 B2 | 8/2015 | Chakraborty et al. |
| 9,220,792 B2 | 12/2015 | Chakraborty et al. |
| 9,233,141 B2 | 1/2016 | Chakraborty et al. |
| 9,597,413 B2 | 3/2017 | Guild et al. |
| 9,814,760 B2 | 11/2017 | Bancel et al. |
| 10,137,086 B2 | 11/2018 | DeRosa et al. |
| 10,702,478 B2 | 7/2020 | Guild et al. |
| 2014/0148502 A1 | 5/2014 | Bancel et al. |
| 2014/0155472 A1 | 6/2014 | Bancel et al. |
| 2014/0155473 A1 | 6/2014 | Bancel et al. |
| 2014/0155474 A1 | 6/2014 | Bancel et al. |
| 2014/0155475 A1 | 6/2014 | Bancel et al. |
| 2014/0193482 A1 | 7/2014 | Bancel et al. |
| 2014/0194494 A1 | 7/2014 | Bancel et al. |

(Continued)

FOREIGN PATENT DOCUMENTS

| | | |
|---|---|---|
| WO | WO2007024708 | 3/2007 |
| WO | WO2008045548 | 4/2008 |

(Continued)

OTHER PUBLICATIONS

Azita et al., "Chemically Modified mRNA as a Novel Treatment for Cystic Fibrosis", European Respiratory Journal, 2013, vol. 42, Supp. 57, European Respiratory Society Annual Congress, Barcelona, Sep. 7-11, 2013, Abstract No. 5066.

Ekambaram et al., "Solid Lipid Nanoparticles: A Review", Scientific Reviews and Chemical Communications, 2012, vol. 2, pp. 80-102.

Extended European Search Report in European Application No. 17800209.3, dated Mar. 24, 2020, 11 pages.

Gershman A.J. et al., "Cystic Fibrosis in Adults: An Overview for the Internist", Cleveland Clinic Journal of Medicine, 2006, vol. 73, pp. 1065-1074.

(Continued)

*Primary Examiner* — Alma Pipic
(74) *Attorney, Agent, or Firm* — Fish & Richardson P.C.

(57) ABSTRACT

The invention relates to mRNA therapy for the treatment of cystic fibrosis. mRNAs for use in the invention, when administered in vivo, encode cystic fibrosis transmembrane conductance regulator (CFTR), isoforms thereof, functional fragments thereof, and fusion proteins comprising CFTR. mRNAs of the invention are preferably encapsulated in lipid nanoparticles (LNPs) to effect efficient delivery to cells and/or tissues in subjects, when administered thereto. mRNA therapies of the invention increase and/or restore deficient levels of CFTR expression and/or activity in subjects. mRNA therapies of the invention further decrease levels of toxic metabolites associated with deficient CFTR activity in subjects.

30 Claims, 90 Drawing Sheets
Specification includes a Sequence Listing.

(56) References Cited

U.S. PATENT DOCUMENTS

| | | |
|---|---|---|
| 2014/0200263 A1 | 7/2014 | Bancel et al. |
| 2014/0275229 A1 | 9/2014 | Bancel et al. |
| 2018/0161451 A1 | 6/2018 | Fotin-Mleczek et al. |
| 2018/0263918 A1 | 9/2018 | DeRosa et al. |
| 2018/0311381 A1 | 11/2018 | Bancel et al. |
| 2019/0175517 A1 | 6/2019 | Martini et al. |
| 2019/0298657 A1 | 10/2019 | Martini et al. |
| 2019/0300906 A1 | 10/2019 | Martini et al. |
| 2019/0390181 A1 | 12/2019 | Benenato et al. |
| 2020/0078314 A1 | 3/2020 | Martini et al. |
| 2020/0085916 A1 | 3/2020 | Martini et al. |

FOREIGN PATENT DOCUMENTS

| | | |
|---|---|---|
| WO | WO2011068810 | 6/2011 |
| WO | WO2012138453 | 10/2012 |
| WO | WO2012170930 | 12/2012 |
| WO | WO2013086373 | 6/2013 |
| WO | WO2013119880 | 8/2013 |
| WO | WO2013149141 | 10/2013 |
| WO | WO2013151666 | 10/2013 |
| WO | WO2013182683 | 12/2013 |
| WO | WO2013185069 | 12/2013 |
| WO | WO2014081507 | 5/2014 |
| WO | 2014/153052 A2 * | 9/2014 |
| WO | WO2014152513 | 9/2014 |
| WO | WO2015061467 | 4/2015 |
| WO | 2015/199952 A1 * | 12/2015 |
| WO | WO2016004318 | 1/2016 |
| WO | WO2016011306 | 1/2016 |
| WO | WO2016118724 | 7/2016 |
| WO | WO2017049245 | 3/2017 |
| WO | WO2017070616 | 4/2017 |
| WO | WO2017075531 | 5/2017 |
| WO | WO2017153936 | 9/2017 |
| WO | WO2017191274 | 11/2017 |
| WO | WO2018089790 | 5/2018 |
| WO | WO2018157154 | 8/2018 |
| WO | WO2018202884 | 11/2018 |
| WO | WO2018213476 | 11/2018 |
| WO | WO2020023533 | 1/2020 |
| WO | WO2020106946 | 5/2020 |
| WO | WO2020146381 | 7/2020 |
| WO | WO2021021988 | 2/2021 |
| WO | WO2021055609 | 3/2021 |
| WO | WO2021150997 | 7/2021 |
| WO | WO2021222222 | 11/2021 |
| WO | WO2021222801 | 11/2021 |
| WO | WO2021226468 | 11/2021 |
| WO | WO2022099194 | 5/2022 |
| WO | WO2022104131 | 5/2022 |

OTHER PUBLICATIONS

International Search Report and Written Opinion in International Application No. PCT/US2017/033419 dated Aug. 23, 2017, 17 pages.

Lukowski et al., "CFTR mRNA Expression is Regulated by an Upstream Open Reading Frame and RNA Secondary Structure in its 5' Untranslated Region", Human Molecular Genetics, 2015, vol. 24, pp. 899-912.

Partial Supplementary European Search Report in European Application No. 17800209.3, dated Dec. 17, 2019, 13 pages.

Porteous et al., "Evidence for Safety and Efficacy of DOTAP Cationic Liposome Mediated CFTR Gene Transfer to the Nasal Epithelium of Patients with Cystic Fibrosis", Gene Therapy, 1997, vol. 4, pp. 210-218.

Presnyak et al., "Codon Optimality Is A Major Determinant of mRNA Stability", Cell, 2015, vol. 160, pp. 1111-1124.

Ratjen F, et al., "Cystic Fibrosis", The Lancet, 2003, vol. 361, pp. 681-689 (Abstract).

Tavernier et al., "mRNA as gene therapeutic: How to control protein expression", Journal of Controlled Release, 2011, 152:238-247.

Welsh, M. J., "Cystic Fibrosis", Journal of Clinical Investigation, 1987, vol. 80, pp. 1523-1526.

Yamamoto et al., "Current Prospects for mRNA Gene Delivery", European Journal of Pharmaceutics and Biopharmaceutics, 2008, 6 pages.

* cited by examiner

A

SEQ ID NO: 1 (CFTR, Cystic fibrosis transmembrane conductance regulator, wt, isoform 1)

```
MQRSPLEKASVVSKLFFSWTRPILRKGYRQRLELSDIYQIPSVDSAD
NLSEKLEREWDRELASKKNPKLINALRRCFFWRFMFYGIFLYLGEVT
KAVQPLLLGRIIASYDPDNKEERSIAIYLGIGLCLLFIVRTLLLHPA
IFGLHHIGMQMRIAMFSLIYKKTLKLSSRVLDKISIGQLVSLLSNNL
NKFDEGLALAHFVWIAPLQVALLMGLIWELLQASAFCGLGFLIVLAL
FQAGLGRMMMKYRDQRAGKISERLVITSEMIENIQSVKAYCWEEAME
KMIENLRQTELKLTRKAAYVRYFNSSAFFFSGFFVVFLSVLPYALIK
GIILRKIFTTISFCIVLRMAVTRQFPWAVQTWYDSLGAINKIQDFLQ
KQEYKTLEYNLTTTEVVMENVTAFWEEGFGELFEKAKQNNNNRKTSN
GDDSLFFSNFSLLGTPVLKDINFKIERGQLLAVAGSTGAGKTSLLMV
IMGELEPSEGKIKHSGRISFCSQFSWIMPGTIKENIIFGVSYDEYRY
RSVIKACQLEEDISKFAEKDNIVLGEGGITLSGGQRARISLARAVYK
DADLYLLDSPFGYLDVLTEKEIFESCVCKLMANKTRILVTSKMEHLK
KADKILILHEGSSYFYGTFSELQNLQPDFSSKLMGCDSFDQFSAERR
NSILTETLHRFSLEGDAPVSWTETKKQSFKQTGEFGEKRKNSILNPI
NSIRKFSIVQKTPLQMNGIEEDSDEPLERRLSLVPDSEQGEAILPRI
SVISTGPTLQARRRQSVLNLMTHSVNQGQNIHRKTTASTRKVSLAPQ
ANLTELDIYSRRLSQETGLEISEEINEEDLKECFFDDMESIPAVTTW
NTYLRYITVHKSLIFVLIWCLVIFLAEVAASLVVLWLLGNTPLQDKG
NSTHSRNNSYAVIITSTSSYYVFYIYVGVADTLLAMGFFRGLPLVHT
LITVSKILHHKMLHSVLQAPMSTLNTLKAGGILNRFSKDIAILDDLL
PLTIFDFIQLLLIVIGAIAVVAVLQPYIFVATVPVIVAFIMLRAYFL
QTSQQLKQLESEGRSPIFTHLVTSLKGLWTLRAFGRQPYFETLFHKA
LNLHTANWFLYLSTLRWFQMRIEMIFVIFFIAVTFISILTTGEGEGR
VGIILTLAMNIMSTLQWAVNSSIDVDSLMRSVSRVFKFIDMPTEGKP
TKSTKPYKNGQLSKVMIIENSHVKKDDIWPSGGQMTVKDLTAKYTEG
GNAILENISFSISPGQRVGLLGRTGSGKSTLLSAFLRLLNTEGEIQI
DGVSWDSITLQQWRKAFGVIPQKVFIFSGTFRKNLDPYEQWSDQEIW
KVADEVGLRSVIEQFPGKLDFVLVDGGCVLSHGHKQLMCLARSVLSK
AKILLLDEPSAHLDPVTYQIIRRTLKQAFADCTVILCEHRIEAMLEC
QQFLVIEENKVRQYDSIQKLLNERSLFRQAISPSDRVKLFPHRNSSK
CKSKPQIAALKEETEEEVQDTRL
```

See cystic fibrosis transmembrane conductance regulator, Uniprot Acc. No. P13569.

| Feature | Position | Length | Description |
|---|---|---|---|
| Transmembrane | 81-103 | | |
| Domain | 81-365 | 285 | ABC transmembrane type-1 1 |
| Transmembrane | 118-138 | | |
| Transmembrane | 195-215 | | |
| Transmembrane | 221-241 | | |
| Transmembrane | 308-328 | | |
| Transmembrane | 331-350 | | |
| Domain | 423-646 | 224 | ABC transporter 1 |
| Domain | 458-465 | 8 | ATP1 domain - nucleotide binding |
| Domain | 859-1155 | 297 | ABC transmembrane type-1 2 |
| Transmembrane | 860-880 | | |
| Transmembrane | 912-932 | | |
| Transmembrane | 991-1011 | | |
| Transmembrane | 1014-1034 | | |
| Transmembrane | 1103-1123 | | |
| Transmembrane | 1129-1149 | | |
| Domain | 1210-1443 | 224 | ABC transporter 2 |
| Domain | 1244-1251 | 8 | ATP2 domain - nucleotide binding |
| Motif | 1478-1480 | 3 | PDZ-binding |

SEQ ID NO: 2

```
ATGCAGAGGTCGCCTCTGGAAAAGGCCAGCGTTGTCTCCAAACTTTTTTTCAGCTGGAC
CAGACCAATTTTGAGGAAAGGATACAGACAGCGCCTGGAATTGTCAGACATATACCAAA
TCCCTTCTGTTGATTCTGCTGACAATCTATCTGAAAAATTGGAAAGAGAATGGGATAGA
GAGCTGGCTTCAAAGAAAAATCCTAAACTCATTAATGCCCTTCGGCGATGTTTTTCTG
GAGATTTATGTTCTATGGAATCTTTTTATATTTAGGGGAAGTCACCAAAGCAGTACAGC
CTCTCTTACTGGGAAGAATCATAGCTTCCTATGACCCGGATAACAAGGAGGAACGCTCT
ATCGCGATTTATCTAGGCATAGGCTTATGCCTTCTCTTTATTGTGAGGACACTGCTCCT
ACACCCAGCCATTTTGGCCTTCATCACATTGGAATGCAGATGAGAATAGCTATGTTA
GTTTGATTTATAAGAAGACTTTAAAGCTGTCAAGCCGTGTTCTAGATAAAATAAGTATT
GGACAACTTGTTAGTCTCCTTTCCAACAACCTGAACAAATTTGATGAAGGACTTGCATT
GGCACATTTCGTGTGGATCGCTCCTTTGCAAGTGGCACTCCTCATGGGCTAATCTGGG
AGTTGTTACAGGCGTCTGCCTTCTGTGGACTTGGTTCCTGATAGTCCTTGCCCTTTTT
CAGGCTGGGCTAGGGAGAATGATGATGAAGTACAGAGATCAGAGAGCTGGGAAGATCAG
TGAAAGACTTGTGATTACCTCAGAAATGATTGAAAATATCCAATCTGTTAAGGCATACT
GCTGGGAAGAAGCAATGGAAAAAATGATTGAAAACTTAAGACAAACAGAACTGAAACTG
ACTCGGAAGGCAGCCTATGTGAGATACTTCAATAGCTCAGCCTTCTTCTTCTCAGGGTT
CTTTGTGGTGTTTTATCTGTGCTTCCCTATGCACTAATCAAAGGAATCATCCTCCGGA
AATATTCACCACCATCTCATTCTGCATTGTTCTGCGCATGGCGGTCACTCGGCAATTT
CCCTGGGCTGTACAAACATGGTATGACTCTCTTGGAGCAATAAACAAAATACAGGATTT
CTTACAAAAGCAAGAATATAAGACATTGGAATATAACTTAACGACTACAGAAGTAGTGA
TGGAGAATGTAACAGCCTTCTGGGAGGAGGGATTTGGGGAATTATTTGAGAAAGCAAAA
CAAAACAATAACAATAGAAAAACTTCTAATGGTGATGACAGCCTCTTCTTCAGTAATTT
CTCACTTCTTGGTACTCCTGTCCTGAAAGATATTAATTTCAAGATAGAAAGAGGACAGT
TGTTGGCGGTTGCTGGATCCACTGGAGCAGGCAAGACTTCACTTCTAATGGTGATTATG
GGAGAACTGGAGCCTTCAGAGGGTAAAATTAAGCACAGTGGAAGAATTTCATTCTGTTC
TCAGTTTTCCTGGATTATGCCTGGCACCATTAAAGAAAATATCATCTTTGGTGTTTCCT
ATGATGAATATAGATACAGAAGCGTCATCAAAGCATGCCAACTAGAAGAGGACATCTCC
AAGTTTGCAGAGAAAGACAATATAGTTCTTGGAGAAGGTGGAATCACACTGAGTGGAGG
TCAACGAGCAAGAATTTCTTTAGCAAGAGCAGTATACAAAGATGCTGATTTGTATTTAT
TAGACTCTCCTTTTGGATACCTAGATGTTTTAACAGAAAAGAAATATTTGAAAGCTGT
GTCTGTAAACTGATGGCTAACAAAACTAGGATTTTGGTCACTTCTAAAATGGAACATTT
AAAGAAAGCTGACAAATATTAATTTTGCATGAAGGTAGCAGCTATTTTATGGGACAT
TTTCAGAACTCCAAAATCTACAGCCAGACTTTAGCTCAAAACTCATGGGATGTGATTCT
TTCGACCAATTTAGTGCAGAAAGAAGAAATTCAATCCTAACTGAGACCTTACACCGTTT
CTCATTAGAAGGAGATGCTCCTGTCTCCTGGACAGAAACAAAAAAACAATCTTTTAAAC
AGACTGGAGAGTTTGGGGAAAAAGGAAGAATTCTATTCTCAATCCAATCAACTCTATA
CGAAAATTTTCCATTGTGCAAAAGACTCCCTTACAA
```

SEQ ID NO: 2 cont

```
ATGAATGGCATCGAAGAGGATTCTGATGAGCCTTTAGAGAGAAGGCTGTCCTTAGTACC
AGATTCTGAGCAGGGAGAGGCGATACTGCCTCGCATCAGCGTGATCAGCACTGGCCCCA
CGCTTCAGGCACGAAGGAGGCAGTCTGTCCTGAACCTGATGACACACTCAGTTAACCAA
GGTCAGAACATTCACCGAAAGACAACAGCATCCACACGAAAAGTGTCACTGGCCCCTCA
GGCAAACTTGACTGAACTGGATATATATTCAAGAAGGTTATCTCAAGAAACTGGCTTGG
AAATAAGTGAAGAAATTAACGAAGAAGACTTAAAGGAGTGCTTTTTTGATGATATGGAG
AGCATACCAGCAGTGACTACATGGAACACATACCTTCGATATATTACTGTCCACAAGAG
CTTAATTTTTGTGCTAATTTGGTGCTTAGTAATTTTTCTGGCAGAGGTGGCTGCTTCTT
TGGTTGTGCTGTGGCTCCTTGGAAACACTCCTCTTCAAGACAAAGGGAATAGTACTCAT
AGTAGAAATAACAGCTATGCAGTGATTATCACCAGCACCAGTTCGTATTATGTGTTTTA
CATTTACGTGGGAGTAGCCGACACTTTGCTTGCTATGGGATTCTTCAGAGGTCTACCAC
TGGTGCATACTCTAATCACAGTGTCGAAAATTTTACACCACAAAATGTTACATTCTGTT
CTTCAAGCACCTATGTCAACCCTCAACACGTTGAAAGCAGGTGGGATTCTTAATAGATT
CTCCAAAGATATAGCAATTTTGGATGACCTTCTGCCTCTTACCATATTTGACTTCATCC
AGTTGTTATTAATTGTGATTGGAGCTATAGCAGTTGTCGCAGTTTTACAACCCTACATC
TTTGTTGCAACAGTGCCAGTGATAGTGGCTTTTATTATGTTGAGAGCATATTTCCTCCA
AACCTCACAGCAACTCAAACAACTGGAATCTGAAGGCAGGAGTCCAATTTTCACTCATC
TTGTTACAAGCTTAAAAGGACTATGGACACTTCGTGCCTTCGGACGGCAGCCTTACTTT
GAAACTCTGTTCCACAAAGCTCTGAATTTACATACTGCCAACTGGTTCTTGTACCTGTC
AACACTGCGCTGGTTCCAAATGAGAATAGAAATGATTTTTGTCATCTTCTTCATTGCTG
TTACCTTCATTTCCATTTTAACAACAGGAGAAGGAGAAGGAAGAGTTGGTATTATCCTG
ACTTTAGCCATGAATATCATGAGTACATTGCAGTGGGCTGTAAACTCCAGCATAGATGT
GGATAGCTTGATGCGATCTGTGAGCCGAGTCTTTAAGTTCATTGACATGCCAACAGAAG
GTAAACCTACCAAGTCAACCAAACCATACAAGAATGGCCAACTCTCGAAAGTTATGATT
ATTGAGAATTCACACGTGAAGAAAGATGACATCTGGCCCTCAGGGGCCAAATGACTGT
CAAAGATCTCACAGCAAAATACACAGAAGGTGGAAATGCCATATTAGAGAACATTTCCT
TCTCAATAAGTCCTGGCCAGAGGGTGGGCCTCTTGGGAAGAACTGGATCAGGGAAGAGT
ACTTTGTTATCAGCTTTTTTGAGACTACTGAACACTGAAGGAGAAATCCAGATCGATGG
TGTGTCTTGGGATTCAATAACTTTGCAACAGTGGAGGAAAGCCTTTGGAGTGATACCAC
AGAAAGTATTTATTTTTCTGGAACATTTAGAAAAAACTTGGATCCCTATGAACAGTGG
AGTGATCAAGAAATATGGAAAGTTGCAGATGAGGTTGGGCTCAGATCTGTGATAGAACA
GTTCCTGGGAAGCTTGACTTTGTCCTTGTGGATGGGGCTGTGTCCTAAGCCATGGCC
ACAAGCAGTTGATGTGCTTGGCTAGATCTGTTCTCAGTAAGGCGAAGATCTTGCTGCTT
GATGAACCCAGTGCTCATTTGGATCCAGTAACATACCAAATAATTAGAAGAACTCTAAA
ACAAGCATTTGCTGATTGCACAGTAATTCTCTGTGAACACAGGATAGAAGCAATGCTGG
AATGCCAACAATTTTTGGTCATAGAAGAGAACAAAGTGCGGCAGTACGATTCCATCCAG
AAACTGCTGAACGAGAGGAGCCTCTTCCGGCAAGCCATCAGCCCTCCGACAGGGTGAA
GCTCTTTCCCCACCGGAACTCAAGCAAGTGCAAGTCTAAGCCCCAGATTGCTGCTCT
GAAAGAGGAGACAGAAGAAGAGGTGCAAGATACAAGGCTT
```

FIG. 1 (cont)

SEQ ID NO: 3 (CFTR, Cystic fibrosis transmembrane conductance regulator, wt, isoform 2)

```
MQRSPLEKASVVSKLFFSWTRPILRKGYRQRLELSDIYQIPSVDSAD
NLSEKLEREWDRELASKKNPKLINALRRCFFWRFMFYGIFLYLGEVT
KAVQPLLLGRIIASYDPDNKEERSIAIYLGIGLCLLFIVRTLLLHPA
IFGLHHIGMQMRIAMFSLIYKKTLKLSSRVLDKISIGQLVSLLSNNL
NKFDEGLALAHFVWIAPLQVALLMGLIWELLQASAFCGLGFLIVLAL
FQAGLGRMMMKYRDQRAGKISERLVITSEMIENIQSVKAYCWEEAME
KMIENLRQTELKLTRKAAYVRYFNSSAFFFSGFFVVFLSVLPYALIK
GIILRKIFTTISFCIVLRMAVTRQFPWAVQTWYDSLGAINKIQDFLQ
KQEYKTLEYNLTTTEVVMENVTAFWEETSLLMVIMGELEPSEGKIKH
SGRISFCSQFSWIMPGTIKENIIFGVSYDEYRYRSVIKACQLEEDIS
KFAEKDNIVLGEGGITLSGGQRARISLARAVYKDADLYLLDSPFGYL
DVLTEKEIFESCVCKLMANKTRILVTSKMEHLKKADKILILHEGSSY
FYGTFSELQNLQPDFSSKLMGCDSFDQFSAERRNSILTETLHRFSLE
GDAPVSWTETKKQSFKQTGEFGEKRKNSILNPINSIRKFSIVQKTPL
QMNGIEEDSDEPLERRLSLVPDSEQGEAILPRISVISTGPTLQARRR
QSVLNLMTHSVNQGQNIHRKTTASTRKVSLAPQANLTELDIYSRRLS
QETGLEISEEINEEDLKECFFDDMESIPAVTTWNTYLRYITVHKSLI
FVLIWCLVIFLAEVAASLVVLWLLGNTPLQDKGNSTHSRNNSYAVII
TSTSSYYVFYIYVGVADTLLAMGFFRGLPLVHTLITVSKILHHKMLH
SVLQAPMSTLNTLKAGGILNRFSKDIAILDDLLPLTIFDFIQLLLIV
IGAIAVVAVLQPYIFVATVPVIVAFIMLRAYFLQTSQQLKQLESEGR
SPIFTHLVTSLKGLWTLRAFGRQPYFETLFHKALNLHTANWFLYLST
LRWFQMRIEMIFVIFFIAVTFISILTTGEGEGRVGIILTLAMNIMST
LQWAVNSSIDVDSLMRSVSRVFKFIDMPTEGKPTKSTKPYKNGQLSK
VMIIENSHVKKDDIWPSGGQMTVKDLTAKYTEGGNAILENISFSISP
GQRVGLLGRTGSGKSTLLSAFLRLLNTEGEIQIDGVSWDSITLQQWR
KAFGVIPQKVFIFSGTFRKNLDPYEQWSDQEIWKVADEVGLRSVIEQ
FPGKLDFVLVDGGCVLSHGHKQLMCLARSVLSKAKILLLDEPSAHLD
PVTYQIIRRTLKQAFADCTVILCEHRIEAMLECQQFLVIEENKVRQY
DSIQKLLNERSLFRQAISPSDRVKLFPHRNSSKCKSKPQIAALKEET
EEEVQDTRL
```

See cystic fibrosis transmembrane conductance regulator, Uniprot Acc. No. P13569. The sequence of this isoform differs from the canonical sequence as follows: a.a. 404-464 missing.

FIG. 2

SEQ ID NO: 4 (CFTR, Cystic fibrosis transmembrane conductance regulator, wt, isoform 3)

```
MQRSPLEKASVVSKLFFSWTRPILRKGYRQRLELSDIYQIPSVDSAD
NLSEKLEREWDRELASKKNPKLINALRRCFFWRFMFYGIFLYLGEVT
KAVQPLLLGRIIASYDPDNKEERSIAIYLGIGLCLLFIVRTLLLHPA
IFGLHHIGMQMRIAMFSLIYKKTLKLSSRVLDKISIGQLVSLLSNNL
NKFDEGLALAHFVWIAPLQVALLMGLIWELLQASAFCGLGFLIVLAL
FQAGLGRMMMKYRDQRAGKISERLVITSEMIENIQSVKAYCWEEAME
KMIENLRQTELKLTRKAAYVRYFNSSAFFFSGFFVVFLSVLPYALIK
GIILRKIFTTISFCIVLRMAVTRQFPWAVQTWYDSLGAINKIQDFLQ
KQEYKTLEYNLTTTEVVMENVTAFWEEGFGELFEKAKQNNNNRKTSN
GDDSLFFSNFSLLGTPVLKDINFKIERGQLLAVAGSTGAGKTSLLMV
IMGELEPSEGKIKHSGRISFCSQFSWIMPGTIKENIIFGVSYDEYRY
RSVIKACQLEEDISKFAEKDNIVLGEGGITLSGGQRARISLARAVYK
DADLYLLDSPFGYLDVLTEKEIFERRRCSCLLDRNKKTIF
```

See cystic fibrosis transmembrane conductance regulator, Uniprot Acc. No. P13569. The sequence of this isoform differs from the canonical sequence as follows: a.a. 589-605 are replaced with an alternate sequence and a.a. 606-1480 are missing.

FIG. 3

| Protein | Length | Theoretical Minimum U (%) | Theoretical Minimum U (abs) | | | | | | | | |
|---|---|---|---|---|---|---|---|---|---|---|---|
| CFTR PROTEIN | 1480 | 14.91% | 662 | | | | | | | | |
| Nucleic Acid | Length | U Content (abs) | U Content (%) | U Content v WT (%) | U Content v Theoretical Minimum (%) | UU pairs | UU pairs v WT (%) | UUU | UUUU | UUUUU |
| CFTR-WT | 4440 | 1235 | 27.82% | 100.00% | 186.56% | 170 | 100.00% | 59 | 16 | 9 |
| CFTR-C001 | 4440 | 813 | 18.31% | 65.83% | 122.81% | 77 | 45.29% | 12 | 4 | 1 |
| CFTR-C002 | 4440 | 815 | 18.36% | 65.99% | 123.11% | 74 | 43.53% | 13 | 2 | 1 |
| CFTR-C003 | 4440 | 823 | 18.54% | 66.64% | 124.32% | 70 | 41.18% | 20 | 3 | 2 |
| CFTR-C004 | 4440 | 795 | 17.91% | 64.37% | 120.09% | 75 | 44.12% | 14 | 4 | 0 |
| CFTR-C005 | 4440 | 792 | 17.84% | 64.13% | 119.64% | 67 | 39.41% | 16 | 2 | 4 |
| CFTR-C006 | 4440 | 816 | 18.38% | 66.07% | 123.26% | 83 | 48.82% | 13 | 3 | 2 |
| CFTR-C007 | 4440 | 817 | 18.40% | 66.15% | 123.41% | 74 | 43.53% | 17 | 4 | 2 |
| CFTR-C008 | 4440 | 801 | 18.04% | 64.86% | 121.00% | 70 | 41.18% | 20 | 2 | 3 |
| CFTR-C009 | 4440 | 827 | 18.63% | 66.96% | 124.92% | 77 | 45.29% | 21 | 2 | 2 |
| CFTR-C010 | 4440 | 810 | 18.24% | 65.59% | 122.36% | 81 | 47.65% | 15 | 1 | 1 |
| CFTR-C011 | 4440 | 815 | 18.36% | 65.99% | 123.11% | 73 | 42.94% | 20 | 1 | 2 |
| CFTR-C012 | 4440 | 821 | 18.49% | 66.40% | 124.02% | 73 | 42.94% | 18 | 2 | 0 |
| CFTR-C013 | 4440 | 798 | 17.97% | 64.62% | 120.54% | 81 | 47.65% | 14 | 3 | 1 |
| CFTR-C014 | 4440 | 827 | 18.63% | 66.96% | 124.92% | 61 | 35.88% | 28 | 5 | 1 |
| CFTR-C015 | 4440 | 806 | 18.15% | 65.26% | 121.75% | 76 | 44.71% | 14 | 4 | 1 |
| CFTR-C016 | 4440 | 831 | 18.72% | 67.29% | 125.53% | 85 | 50.00% | 14 | 4 | 2 |
| CFTR-C017 | 4440 | 794 | 17.88% | 64.29% | 119.94% | 75 | 44.12% | 15 | 5 | 2 |
| CFTR-C018 | 4440 | 832 | 18.74% | 67.37% | 125.68% | 79 | 46.47% | 13 | 6 | 1 |
| CFTR-C019 | 4440 | 806 | 18.15% | 65.26% | 121.75% | 79 | 46.47% | 16 | 3 | 1 |
| CFTR-C020 | 4440 | 813 | 18.31% | 65.83% | 122.81% | 77 | 45.29% | 17 | 4 | 2 |
| CFTR-C021 | 4440 | 801 | 18.04% | 64.86% | 121.00% | 80 | 47.06% | 16 | 5 | 2 |
| CFTR-C022 | 4440 | 798 | 17.97% | 64.62% | 120.54% | 72 | 42.35% | 21 | 5 | 0 |
| CFTR-C023 | 4440 | 823 | 18.54% | 66.64% | 124.32% | 72 | 42.35% | 17 | 4 | 0 |
| CFTR-C024 | 4440 | 808 | 18.20% | 65.43% | 122.05% | 78 | 45.88% | 13 | 3 | 1 |

FIG. 5

| | | | | | | | | | | |
|---|---|---|---|---|---|---|---|---|---|---|
| CFTR-C025 | 4440 | 822 | 18.51% | 66.56% | 124.17% | 80 | 47.06% | 14 | 4 | 2 |
| CFTR-C026 | 4440 | 813 | 18.31% | 65.83% | 122.81% | 77 | 45.29% | 12 | 4 | 1 |
| CFTR-C027 | 4440 | 815 | 18.36% | 65.99% | 123.11% | 74 | 43.53% | 12 | 2 | 1 |
| CFTR-C028 | 4440 | 823 | 18.54% | 66.64% | 124.32% | 70 | 41.18% | 20 | 3 | 2 |
| CFTR-C029 | 4440 | 795 | 17.91% | 64.37% | 120.09% | 75 | 44.12% | 14 | 4 | 0 |
| CFTR-C030 | 4440 | 792 | 17.84% | 64.13% | 119.64% | 67 | 39.41% | 16 | 2 | 4 |
| CFTR-C031 | 4440 | 816 | 18.38% | 66.07% | 123.26% | 83 | 48.82% | 13 | 3 | 2 |
| CFTR-C032 | 4440 | 817 | 18.40% | 66.15% | 123.41% | 74 | 43.53% | 17 | 4 | 2 |
| CFTR-C033 | 4440 | 801 | 18.04% | 64.86% | 121.00% | 70 | 41.18% | 20 | 2 | 3 |
| CFTR-C034 | 4440 | 827 | 18.63% | 66.96% | 124.92% | 77 | 45.29% | 21 | 2 | 2 |
| CFTR-C035 | 4440 | 810 | 18.24% | 65.59% | 122.36% | 81 | 47.65% | 15 | 1 | 1 |
| CFTR-C036 | 4440 | 815 | 18.36% | 65.99% | 123.11% | 73 | 42.94% | 20 | 2 | 2 |
| CFTR-C037 | 4440 | 821 | 18.49% | 66.48% | 124.02% | 73 | 42.94% | 18 | 3 | 0 |
| CFTR-C038 | 4440 | 798 | 17.97% | 64.62% | 120.54% | 81 | 47.65% | 14 | 3 | 1 |
| CFTR-C039 | 4440 | 827 | 18.63% | 66.96% | 124.92% | 61 | 35.88% | 20 | 5 | 1 |
| CFTR-C040 | 4440 | 806 | 18.15% | 65.28% | 121.75% | 76 | 44.71% | 14 | 4 | 2 |
| CFTR-C041 | 4440 | 831 | 18.72% | 67.29% | 125.53% | 85 | 50.00% | 14 | 4 | 2 |
| CFTR-C042 | 4440 | 794 | 17.88% | 64.29% | 119.94% | 75 | 44.12% | 15 | 5 | 1 |
| CFTR-C043 | 4440 | 832 | 18.74% | 67.37% | 125.68% | 79 | 46.47% | 13 | 6 | 1 |
| CFTR-C044 | 4440 | 806 | 18.15% | 65.28% | 121.75% | 79 | 46.47% | 16 | 3 | 2 |
| CFTR-C045 | 4440 | 813 | 18.31% | 65.83% | 122.81% | 77 | 45.29% | 17 | 4 | 2 |
| CFTR-C046 | 4440 | 801 | 18.04% | 64.86% | 121.00% | 80 | 47.06% | 16 | 5 | 0 |
| CFTR-C047 | 4440 | 798 | 17.97% | 64.62% | 120.54% | 72 | 42.35% | 21 | 5 | 0 |
| CFTR-C048 | 4440 | 823 | 18.54% | 66.64% | 124.32% | 72 | 42.35% | 17 | 4 | 1 |
| CFTR-C049 | 4440 | 809 | 18.20% | 65.49% | 122.05% | 78 | 45.88% | 13 | 3 | 2 |
| CFTR-C050 | 4440 | 822 | 18.51% | 66.56% | 124.17% | 80 | 47.06% | 14 | 4 | 4 |
| | MAX | 832 | 18.74% | 67.37% | 125.68% | 85 | 50.00% | 28 | 6 | 4 |
| | MIN | 792 | 17.84% | 64.13% | 119.64% | 61 | 35.88% | 12 | 1 | 0 |
| | AVERAGE | 812.16 | 18.29% | 65.76% | 122.68% | 75.56 | 44.45% | 16.44 | 3.4 | 1.44 |
| | MEDIAN | 813 | 18.31% | 65.83% | 122.81% | 76 | 44.71% | 16 | 4 | 1 |
| | STD DEV | 11.84 | 0.27% | 0.96% | 1.79% | 5.23 | 3.08% | | | |

FIG. 5 (cont)

| Protein | Length | Theoretical Maximum G (%) | Theoretical Maximum G (abs) | | |
|---|---|---|---|---|---|
| CFTR Protein | 1480 | 38.11% | 1692 | | |
| Nucleic Acid | Length | G Content (abs) | G Content (%) | G Content v WT (%) | G Content v Theoretical Maximum (%) |
| CFTR-WT | 4440 | 971 | 21.87% | 100.00% | 57.39% |
| CFTR-CO01 | 4440 | 1285 | 28.94% | 132.34% | 75.95% |
| CFTR-CO02 | 4440 | 1251 | 28.18% | 128.84% | 73.94% |
| CFTR-CO03 | 4440 | 1283 | 28.90% | 132.13% | 75.83% |
| CFTR-CO04 | 4440 | 1296 | 29.19% | 133.47% | 76.60% |
| CFTR-CO05 | 4440 | 1292 | 29.10% | 133.06% | 76.36% |
| CFTR-CO06 | 4440 | 1248 | 28.11% | 128.53% | 73.76% |
| CFTR-CO07 | 4440 | 1266 | 28.51% | 130.38% | 74.82% |
| CFTR-CO08 | 4440 | 1283 | 28.90% | 132.13% | 75.83% |
| CFTR-CO09 | 4440 | 1257 | 28.31% | 129.45% | 74.29% |
| CFTR-CO10 | 4440 | 1278 | 28.78% | 131.62% | 75.53% |
| CFTR-CO11 | 4440 | 1273 | 28.67% | 131.10% | 75.24% |
| CFTR-CO12 | 4440 | 1288 | 29.01% | 132.65% | 76.12% |
| CFTR-CO13 | 4440 | 1286 | 28.96% | 132.44% | 76.00% |
| CFTR-CO14 | 4440 | 1267 | 28.54% | 130.48% | 74.88% |
| CFTR-CO15 | 4440 | 1261 | 28.40% | 129.87% | 74.53% |
| CFTR-CO16 | 4440 | 1285 | 28.94% | 132.34% | 75.95% |
| CFTR-CO17 | 4440 | 1291 | 29.08% | 132.96% | 76.30% |
| CFTR-CO18 | 4440 | 1277 | 28.76% | 131.51% | 75.47% |
| CFTR-CO19 | 4440 | 1265 | 28.49% | 130.28% | 74.76% |
| CFTR-CO20 | 4440 | 1270 | 28.60% | 130.79% | 75.06% |
| CFTR-CO21 | 4440 | 1286 | 28.96% | 132.44% | 76.00% |
| CFTR-CO22 | 4440 | 1272 | 28.65% | 131.00% | 75.18% |
| CFTR-CO23 | 4440 | 1266 | 28.51% | 130.38% | 74.82% |
| CFTR-CO24 | 4440 | 1242 | 27.97% | 127.91% | 73.40% |

FIG. 6

| | | | | | |
|---|---|---|---|---|---|
| CFTR-C025 | 4440 | 1272 | 28.65% | 131.00% | 75.18% |
| CFTR-C026 | 4440 | 1285 | 28.94% | 132.34% | 75.95% |
| CFTR-C027 | 4440 | 1251 | 28.18% | 128.84% | 73.94% |
| CFTR-C028 | 4440 | 1283 | 28.90% | 132.13% | 75.83% |
| CFTR-C029 | 4440 | 1296 | 29.19% | 133.47% | 76.60% |
| CFTR-C030 | 4440 | 1292 | 29.10% | 133.06% | 76.36% |
| CFTR-C031 | 4440 | 1248 | 28.11% | 128.53% | 73.76% |
| CFTR-C032 | 4440 | 1266 | 28.51% | 130.38% | 74.82% |
| CFTR-C033 | 4440 | 1283 | 28.90% | 132.13% | 75.83% |
| CFTR-C034 | 4440 | 1257 | 28.31% | 129.45% | 74.29% |
| CFTR-C035 | 4440 | 1278 | 28.78% | 131.62% | 75.53% |
| CFTR-C036 | 4440 | 1273 | 28.67% | 131.10% | 75.24% |
| CFTR-C037 | 4440 | 1288 | 29.01% | 132.65% | 76.12% |
| CFTR-C038 | 4440 | 1286 | 28.96% | 132.44% | 76.00% |
| CFTR-C039 | 4440 | 1267 | 28.54% | 130.48% | 74.88% |
| CFTR-C040 | 4440 | 1261 | 28.40% | 129.87% | 74.53% |
| CFTR-C041 | 4440 | 1285 | 28.94% | 132.34% | 75.95% |
| CFTR-C042 | 4440 | 1291 | 29.08% | 132.96% | 76.30% |
| CFTR-C043 | 4440 | 1277 | 28.76% | 131.51% | 75.47% |
| CFTR-C044 | 4440 | 1265 | 28.49% | 130.28% | 74.76% |
| CFTR-C045 | 4440 | 1270 | 28.60% | 130.79% | 75.06% |
| CFTR-C046 | 4440 | 1286 | 28.96% | 132.44% | 76.00% |
| CFTR-C047 | 4440 | 1272 | 28.65% | 131.00% | 75.18% |
| CFTR-C048 | 4440 | 1266 | 28.51% | 130.38% | 74.82% |
| CFTR-C049 | 4440 | 1242 | 27.97% | 127.91% | 73.40% |
| CFTR-C050 | 4440 | 1272 | 28.65% | 131.00% | 75.18% |
| | MAX | 1296 | 29.19% | 133.47% | 76.60% |
| | MIN | 1242 | 27.97% | 127.91% | 73.40% |
| | AVERAGE | 1273.6 | 28.68% | 131.16% | 75.27% |
| | MEDIAN | 1273 | 28.67% | 131.10% | 75.24% |
| | STD DEV | 14.25 | 0.32% | 1.47% | 0.84% |

FIG. 6 (cont)

| Protein | Length | Theoretical Maximum C | Theoretical Maximum C (abs) | | |
|---|---|---|---|---|---|
| CFTR Protein | 1480 | 42.79% | 1900 | | |
| Nucleic Acid | Length | C Content (abs) | C Content (%) | C Content v WT (%) | C Content v Theoretical Maximum (%) |
| CFTR-WT | 4440 | 873 | 19.66% | 100.00% | 45.95% |
| CFTR-CO01 | 4440 | 1317 | 29.66% | 150.86% | 69.32% |
| CFTR-CO02 | 4440 | 1350 | 30.41% | 154.64% | 71.05% |
| CFTR-CO03 | 4440 | 1318 | 29.68% | 150.97% | 69.37% |
| CFTR-CO04 | 4440 | 1340 | 30.18% | 153.49% | 70.53% |
| CFTR-CO05 | 4440 | 1330 | 29.95% | 152.35% | 70.00% |
| CFTR-CO06 | 4440 | 1336 | 30.09% | 153.04% | 70.32% |
| CFTR-CO07 | 4440 | 1342 | 30.23% | 153.72% | 70.63% |
| CFTR-CO08 | 4440 | 1335 | 30.07% | 152.92% | 70.26% |
| CFTR-CO09 | 4440 | 1338 | 30.14% | 153.26% | 70.42% |
| CFTR-CO10 | 4440 | 1324 | 29.82% | 151.66% | 69.68% |
| CFTR-CO11 | 4440 | 1332 | 30.00% | 152.58% | 70.11% |
| CFTR-CO12 | 4440 | 1323 | 29.80% | 151.55% | 69.63% |
| CFTR-CO13 | 4440 | 1333 | 30.02% | 152.69% | 70.16% |
| CFTR-CO14 | 4440 | 1324 | 29.82% | 151.66% | 69.68% |
| CFTR-CO15 | 4440 | 1339 | 30.16% | 153.38% | 70.47% |
| CFTR-CO16 | 4440 | 1317 | 29.66% | 150.86% | 69.32% |
| CFTR-CO17 | 4440 | 1325 | 29.84% | 151.78% | 69.74% |
| CFTR-CO18 | 4440 | 1315 | 29.62% | 150.63% | 69.21% |
| CFTR-CO19 | 4440 | 1349 | 30.38% | 154.52% | 71.00% |
| CFTR-CO20 | 4440 | 1333 | 30.02% | 152.69% | 70.16% |
| CFTR-CO21 | 4440 | 1348 | 30.36% | 154.41% | 70.95% |
| CFTR-CO22 | 4440 | 1346 | 30.32% | 154.18% | 70.84% |
| CFTR-CO23 | 4440 | 1343 | 30.25% | 153.84% | 70.68% |
| CFTR-CO24 | 4440 | 1356 | 30.54% | 155.33% | 71.37% |

FIG. 7

| | | | | | |
|---|---|---|---|---|---|
| CFTR-C025 | 4440 | 1330 | 29.95% | 152.35% | 70.00% |
| CFTR-C026 | 4440 | 1317 | 29.66% | 150.86% | 69.32% |
| CFTR-C027 | 4440 | 1350 | 30.41% | 154.64% | 71.05% |
| CFTR-C028 | 4440 | 1318 | 29.68% | 150.97% | 69.37% |
| CFTR-C029 | 4440 | 1340 | 30.18% | 153.49% | 70.53% |
| CFTR-C030 | 4440 | 1330 | 29.95% | 152.35% | 70.00% |
| CFTR-C031 | 4440 | 1336 | 30.09% | 153.04% | 70.32% |
| CFTR-C032 | 4440 | 1342 | 30.23% | 153.72% | 70.63% |
| CFTR-C033 | 4440 | 1335 | 30.07% | 152.92% | 70.26% |
| CFTR-C034 | 4440 | 1338 | 30.14% | 153.26% | 70.42% |
| CFTR-C035 | 4440 | 1324 | 29.82% | 151.66% | 69.68% |
| CFTR-C036 | 4440 | 1332 | 30.00% | 152.58% | 70.11% |
| CFTR-C037 | 4440 | 1323 | 29.80% | 151.55% | 69.63% |
| CFTR-C038 | 4440 | 1333 | 30.02% | 152.69% | 70.16% |
| CFTR-C039 | 4440 | 1324 | 29.82% | 151.66% | 69.68% |
| CFTR-C040 | 4440 | 1339 | 30.16% | 153.38% | 70.47% |
| CFTR-C041 | 4440 | 1317 | 29.66% | 150.86% | 69.32% |
| CFTR-C042 | 4440 | 1325 | 29.84% | 151.78% | 69.74% |
| CFTR-C043 | 4440 | 1315 | 29.62% | 150.63% | 69.21% |
| CFTR-C044 | 4440 | 1349 | 30.38% | 154.52% | 71.00% |
| CFTR-C045 | 4440 | 1333 | 30.02% | 152.69% | 70.16% |
| CFTR-C046 | 4440 | 1348 | 30.36% | 154.41% | 70.95% |
| CFTR-C047 | 4440 | 1346 | 30.32% | 154.18% | 70.84% |
| CFTR-C048 | 4440 | 1343 | 30.25% | 153.84% | 70.68% |
| CFTR-C049 | 4440 | 1356 | 30.54% | 155.33% | 71.37% |
| CFTR-C050 | 4440 | 1330 | 29.95% | 152.35% | 70.00% |
| | MAX | 1356 | 30.54% | 155.33% | 71.37% |
| | MIN | 1315 | 29.62% | 150.63% | 69.21% |
| | AVERAGE | 1333.72 | 30.04% | 152.77% | 70.20% |
| | MEDIAN | 1333 | 30.02% | 152.69% | 70.16% |
| | STD DEV | 11.37 | 0.26% | 1.30% | 0.60% |

FIG. 7 (cont)

| Protein | Length | Theoretical Maximum GC | Theoretical Maximum GC (abs) | | |
|---|---|---|---|---|---|
| CFTR Protein | 1480 | 63.58% | 2823 | | |
| Nucleic Acid | Length | GC Content (abs) | GC Content (%) | GC Content v WT (%) | GC Content v Theoretical Maximum (%) |
| CFTR-WT | 4440 | 1844 | 41.53% | 100.00% | 65.32% |
| CFTR-CO01 | 4440 | 2602 | 58.60% | 141.11% | 92.17% |
| CFTR-CO02 | 4440 | 2601 | 58.58% | 141.05% | 92.14% |
| CFTR-CO03 | 4440 | 2601 | 58.58% | 141.05% | 92.14% |
| CFTR-CO04 | 4440 | 2636 | 59.37% | 142.95% | 93.38% |
| CFTR-CO05 | 4440 | 2622 | 59.05% | 142.19% | 92.88% |
| CFTR-CO06 | 4440 | 2584 | 58.20% | 140.13% | 91.53% |
| CFTR-CO07 | 4440 | 2608 | 58.74% | 141.43% | 92.38% |
| CFTR-CO08 | 4440 | 2618 | 58.96% | 141.97% | 92.74% |
| CFTR-CO09 | 4440 | 2595 | 58.45% | 140.73% | 91.92% |
| CFTR-CO10 | 4440 | 2602 | 58.60% | 141.11% | 92.17% |
| CFTR-CO11 | 4440 | 2605 | 58.67% | 141.27% | 92.28% |
| CFTR-CO12 | 4440 | 2611 | 58.81% | 141.59% | 92.49% |
| CFTR-CO13 | 4440 | 2619 | 58.99% | 142.03% | 92.77% |
| CFTR-CO14 | 4440 | 2591 | 58.36% | 140.51% | 91.78% |
| CFTR-CO15 | 4440 | 2600 | 58.56% | 141.00% | 92.10% |
| CFTR-CO16 | 4440 | 2602 | 58.60% | 141.11% | 92.17% |
| CFTR-CO17 | 4440 | 2616 | 58.92% | 141.87% | 92.67% |
| CFTR-CO18 | 4440 | 2592 | 58.38% | 140.56% | 91.82% |
| CFTR-CO19 | 4440 | 2614 | 58.87% | 141.76% | 92.60% |
| CFTR-CO20 | 4440 | 2603 | 58.63% | 141.16% | 92.21% |
| CFTR-CO21 | 4440 | 2634 | 59.32% | 142.84% | 93.30% |
| CFTR-CO22 | 4440 | 2618 | 58.96% | 141.97% | 92.74% |
| CFTR-CO23 | 4440 | 2609 | 58.76% | 141.49% | 92.42% |
| CFTR-CO24 | 4440 | 2598 | 58.51% | 140.89% | 92.03% |

FIG. 8

| | | | | | |
|---|---|---|---|---|---|
| CFTR-C025 | 4440 | 2602 | 58.60% | 141.11% | 92.17% |
| CFTR-C026 | 4440 | 2602 | 58.60% | 141.11% | 92.17% |
| CFTR-C027 | 4440 | 2601 | 58.58% | 141.05% | 92.14% |
| CFTR-C028 | 4440 | 2601 | 58.58% | 141.05% | 92.14% |
| CFTR-C029 | 4440 | 2636 | 59.37% | 142.95% | 93.38% |
| CFTR-C030 | 4440 | 2622 | 59.05% | 142.19% | 92.88% |
| CFTR-C031 | 4440 | 2584 | 58.20% | 140.13% | 91.53% |
| CFTR-C032 | 4440 | 2608 | 58.74% | 141.43% | 92.38% |
| CFTR-C033 | 4440 | 2618 | 58.96% | 141.97% | 92.74% |
| CFTR-C034 | 4440 | 2595 | 58.45% | 140.73% | 91.92% |
| CFTR-C035 | 4440 | 2602 | 58.60% | 141.11% | 92.17% |
| CFTR-C036 | 4440 | 2605 | 58.67% | 141.27% | 92.28% |
| CFTR-C037 | 4440 | 2611 | 58.81% | 141.59% | 92.49% |
| CFTR-C038 | 4440 | 2619 | 58.99% | 142.03% | 92.77% |
| CFTR-C039 | 4440 | 2591 | 58.36% | 140.51% | 91.78% |
| CFTR-C040 | 4440 | 2600 | 58.56% | 141.00% | 92.10% |
| CFTR-C041 | 4440 | 2602 | 58.60% | 141.11% | 92.17% |
| CFTR-C042 | 4440 | 2616 | 58.92% | 141.87% | 92.67% |
| CFTR-C043 | 4440 | 2592 | 58.38% | 140.56% | 91.82% |
| CFTR-C044 | 4440 | 2614 | 58.87% | 141.76% | 92.60% |
| CFTR-C045 | 4440 | 2603 | 58.63% | 141.16% | 92.21% |
| CFTR-C046 | 4440 | 2634 | 59.32% | 142.84% | 93.30% |
| CFTR-C047 | 4440 | 2618 | 58.96% | 141.97% | 92.74% |
| CFTR-C048 | 4440 | 2609 | 58.76% | 141.49% | 92.42% |
| CFTR-C049 | 4440 | 2598 | 58.51% | 140.89% | 92.03% |
| CFTR-C050 | 4440 | 2602 | 58.60% | 141.11% | 92.17% |
| | MAX | 2636 | 59.37% | 142.95% | 93.38% |
| | MIN | 2584 | 58.20% | 140.13% | 91.53% |
| | AVERAGE | 2607.32 | 58.72% | 141.39% | 92.36% |
| | MEDIAN | 2603 | 58.63% | 141.16% | 92.21% |
| | STD DEV | 12.46 | 0.28% | 0.68% | 0.44% |

FIG. 8 (cont)

CFTR

| Sequence | GC | GC 1st | GC 2nd | GC 3rd |
|---|---|---|---|---|
| CFTR-WT | 41.53 | 46.08 | 36.28 | 42.23 |
| CFTR-CO06 | 58.2 | 51.62 | 36.28 | 86.69 |
| CFTR-CO14 | 58.36 | 51.89 | 36.28 | 86.89 |
| CFTR-CO18 | 58.38 | 51.76 | 36.28 | 87.09 |
| CFTR-CO09 | 58.45 | 51.69 | 36.28 | 87.36 |
| CFTR-CO24 | 58.51 | 51.62 | 36.28 | 87.64 |
| CFTR-CO15 | 58.56 | 51.49 | 36.28 | 87.91 |
| CFTR-CO03 | 58.58 | 51.55 | 36.28 | 87.91 |
| CFTR-CO02 | 58.58 | 51.55 | 36.28 | 87.91 |
| CFTR-CO25 | 58.6 | 51.96 | 36.28 | 87.57 |
| CFTR-CO10 | 58.6 | 51.69 | 36.28 | 87.84 |
| CFTR-CO01 | 58.6 | 51.35 | 36.28 | 88.18 |
| CFTR-CO16 | 58.6 | 51.89 | 36.28 | 87.64 |
| CFTR-CO20 | 58.63 | 51.49 | 36.28 | 88.11 |
| CFTR-CO11 | 58.67 | 51.69 | 36.28 | 88.04 |
| CFTR-CO07 | 58.74 | 52.03 | 36.28 | 87.91 |
| CFTR-CO23 | 58.76 | 51.82 | 36.28 | 88.18 |
| CFTR-CO12 | 58.81 | 51.35 | 36.28 | 88.78 |
| CFTR-CO19 | 58.87 | 52.09 | 36.28 | 88.24 |
| CFTR-CO17 | 58.92 | 50.88 | 36.28 | 89.59 |
| CFTR-CO22 | 58.96 | 51.55 | 36.28 | 89.05 |
| CFTR-CO08 | 58.96 | 51.55 | 36.28 | 89.05 |
| CFTR-CO13 | 58.99 | 51.69 | 36.28 | 88.99 |
| CFTR-CO05 | 59.05 | 51.42 | 36.28 | 89.46 |
| CFTR-CO21 | 59.32 | 51.28 | 36.28 | 90.41 |
| CFTR-CO04 | 59.37 | 51.62 | 36.28 | 90.2 |
| Overall | 58.06 | 51.41 | 36.28 | 86.49 |

FIG. 9

```
CFTR-WT     ATGCAGAGGTCGCCTCTGGAAAAGGCCAGCGTTGTCTCCAAACTTTTTTTCAGCTGGACC
CFTR-C001   ATGCAGAGGAGCCCCTCGAAAAGGCCAGCGTGGTCAGCAAGCTGTTCTTCTCCTGGACC
CFTR-C026   ATGCAGAGGAGCCCCTCGAAAAGGCCAGCGTGGTCAGCAAGCTGTTCTTCTCCTGGACC
CFTR-C004   ATGCAAAGGTCCCCCCTGGAGAAGGCCAGCGTGGTGAGCAAGCTGTTCTTCAGCTGGACC
CFTR-C029   ATGCAAAGGTCCCCCCTGGAGAAGGCCAGCGTGGTGAGCAAGCTGTTCTTCAGCTGGACC
CFTR-C021   ATGCAGAGGAGCCCCTTAGAGAAGGCCTCCGTGGTGTCCAAGCTGTTTTTCAGCTGGACC
CFTR-C046   ATGCAGAGGAGCCCCTTAGAGAAGGCCTCCGTGGTGTCCAAGCTGTTTTTCAGCTGGACC
CFTR-C008   ATGCAGAGGAGCCCGCTCGAGAAGGCCAGCGTGGTGTCCAAACTGTTCTTCTCCTGGACG
CFTR-C033   ATGCAGAGGAGCCCGCTCGAGAAGGCCAGCGTGGTGTCCAAACTGTTCTTCTCCTGGACG
CFTR-C022   ATGCAGAGGTCCCCCCTGGAGAAAGCCTCCGTGGTTTCCAAGCTCTTCTTCAGCTGGACC
CFTR-C047   ATGCAGAGGTCCCCCCTGGAGAAAGCCTCCGTGGTTTCCAAGCTCTTCTTCAGCTGGACC
CFTR-C017   ATGCAGCGGAGCCCCCTGGAGAAGGCGAGCGTGGTGAGCAAGCTGTTCTTCAGCTGGACC
CFTR-C042   ATGCAGCGGAGCCCCCTGGAGAAGGCGAGCGTGGTGAGCAAGCTGTTCTTCAGCTGGACC
CFTR-C020   ATGCAGCGGAGCCCCCTGGAGAAGGCATCCGTCGTGTCTAAGCTGTTCTTCAGCTGGACC
CFTR-C045   ATGCAGCGGAGCCCCCTGGAGAAGGCATCCGTCGTGTCTAAGCTGTTCTTCAGCTGGACC
CFTR-C013   ATGCAACGGTCGCCCCTGGAGAAGGCCTCGGTGGTGAGCAAACTGTTCTTCAGCTGGACC
CFTR-C038   ATGCAACGGTCGCCCCTGGAGAAGGCCTCGGTGGTGAGCAAACTGTTCTTCAGCTGGACC
CFTR-C002   ATGCAGAGGAGCCCCTGGAGAAAGCCAGCGTGGTCAGCAAGCTGTTTTTTAGCTGGACC
CFTR-C027   ATGCAGAGGAGCCCCTGGAGAAAGCCAGCGTGGTCAGCAAGCTGTTTTTTAGCTGGACC
CFTR-C011   ATGCAGCGCAGCCCGCTCGAAAAGGCCAGCGTCGTGTCGAAGCTGTTCTTTAGCTGGACC
CFTR-C036   ATGCAGCGCAGCCCGCTCGAAAAGGCCAGCGTCGTGTCGAAGCTGTTCTTTAGCTGGACC
CFTR-C005   ATGCAGAGGTCCCCCCTGGAGAAGGCCAGCGTGGTGAGCAAGCTCTTTTTCAGCTGGACG
CFTR-C030   ATGCAGAGGTCCCCCCTGGAGAAGGCCAGCGTGGTGAGCAAGCTCTTTTTCAGCTGGACG
CFTR-C006   ATGCAGCGGAGCCCCCTCGAGAAGGCCAGCGTTGTCAGCAAGCTGTTTTTCAGCTGGACC
CFTR-C031   ATGCAGCGGAGCCCCCTCGAGAAGGCCAGCGTTGTCAGCAAGCTGTTTTTCAGCTGGACC
CFTR-C018   ATGCAGAGGTCCCCGCTGGAGAAGGCGTCGGTCGTGAGCAAGCTGTTCTTCTCCTGGACT
CFTR-C043   ATGCAGAGGTCCCCGCTGGAGAAGGCGTCGGTCGTGAGCAAGCTGTTCTTCTCCTGGACT
CFTR-C003   ATGCAACGCTCGCCCCTGGAGAAGGCCAGCGTGGTGAGCAAGCTGTTTTTCTCCTGGACG
CFTR-C028   ATGCAACGCTCGCCCCTGGAGAAGGCCAGCGTGGTGAGCAAGCTGTTTTTCTCCTGGACG
CFTR-C016   ATGCAGCGGTCCCCCCTGGAGAAGGCCTCCGTGGTGAGCAAGCTGTTCTTCTCGTGGACC
CFTR-C041   ATGCAGCGGTCCCCCCTGGAGAAGGCCTCCGTGGTGAGCAAGCTGTTCTTCTCGTGGACC
CFTR-C010   ATGCAGCGCAGCCCCTTAGAAAAGGCCAGCGTTGTGTCCAAGCTGTTCTTCTCCTGGACC
CFTR-C035   ATGCAGCGCAGCCCCTTAGAAAAGGCCAGCGTTGTGTCCAAGCTGTTCTTCTCCTGGACC
CFTR-C012   ATGCAGCGGAGCCCCCTGGAGAAGGCTAGCGTCGTGTCCAAGCTGTTCTTTAGCTGGACC
CFTR-C037   ATGCAGCGGAGCCCCCTGGAGAAGGCTAGCGTCGTGTCCAAGCTGTTCTTTAGCTGGACC
CFTR-C009   ATGCAGCGGTCACCCCTGGAAAAGGCCTCCGTGGTGAGCAAGCTGTTCTTCTCCTGGACC
CFTR-C034   ATGCAGCGGTCACCCCTGGAAAAGGCCTCCGTGGTGAGCAAGCTGTTCTTCTCCTGGACC
CFTR-C015   ATGCAGAGGTCCCCCCTTGAGAAGGCCAGCGTGGTGAGCAAGCTGTTCTTCAGCTGGACC
CFTR-C040   ATGCAGAGGTCCCCCCTTGAGAAGGCCAGCGTGGTGAGCAAGCTGTTCTTCAGCTGGACC
CFTR-C019   ATGCAGCGGTCCCCCCTCGAGAAGGCCAGCGTGGTGAGCAAGCTATTCTTCAGCTGGACC
CFTR-C044   ATGCAGCGGTCCCCCCTCGAGAAGGCCAGCGTGGTGAGCAAGCTATTCTTCAGCTGGACC
CFTR-C007   ATGCAGCGAAGCCCCCTGGAGAAGGCCTCCGTGGTGTCCAAACTGTTTTTCTCCTGGACC
CFTR-C032   ATGCAGCGAAGCCCCCTGGAGAAGGCCTCCGTGGTGTCCAAACTGTTTTTCTCCTGGACC
CFTR-C014   ATGCAGAGGAGCCCCTGGAGAAGGCCAGCGTGGTGTCCAAGCTTTTCTTTTCCTGGACC
CFTR-C039   ATGCAGAGGAGCCCCTGGAGAAGGCCAGCGTGGTGTCCAAGCTTTTCTTTTCCTGGACC
CFTR-C025   ATGCAGAGGAGCCCCCTGGAGAAGGCCAGCGTCGTCAGCAAGCTCTTCTTCAGCTGGACG
CFTR-C050   ATGCAGAGGAGCCCCCTGGAGAAGGCCAGCGTCGTCAGCAAGCTCTTCTTCAGCTGGACG
CFTR-C023   ATGCAGAGGTCCCCGCTGGAGAAGGCCTCCGTGGTGTCCAAGCTGTTCTTCTCCTGGACC
CFTR-C048   ATGCAGAGGTCCCCGCTGGAGAAGGCCTCCGTGGTGTCCAAGCTGTTCTTCTCCTGGACC
CFTR-C024   ATGCAGAGGTCCCCCCTGGAGAAGGCCTCCGTGGTGAGCAAGCTGTTCTTCAGCTGGACC
CFTR-C049   ATGCAGAGGTCCCCCCTGGAGAAGGCCTCCGTGGTGAGCAAGCTGTTCTTCAGCTGGACC
            *****.*   **.*.**.**.**    ** **    **.** **.**.   *****
```

FIG. 10

```
CFTR-WT    AGACCAATTTTGAGGAAAGGATACAGACAGCGCCTGGAATTGTCAGACATATACCAAATC
CFTR-C001  CGGCCCATTCTCCGGAAGGGCTACAGGCAGAGGCTGGAGCTGAGCGATATCTACCAGATC
CFTR-C026  CGGCCCATTCTCCGGAAGGGCTACAGGCAGAGGCTGGAGCTGAGCGATATCTACCAGATC
CFTR-C004  CGACCCATCCTCCGCAAGGGCTACAGGCAACGTTTGGAGCTGAGCGATATTTACCAGATC
CFTR-C029  CGACCCATCCTCCGCAAGGGCTACAGGCAACGTTTGGAGCTGAGCGATATTTACCAGATC
CFTR-C021  AGGCCGATACTCAGGAAGGGCTACAGGCAGAGGCTGGAGCTCAGCGACATCTACCAGATC
CFTR-C046  AGGCCGATACTCAGGAAGGGCTACAGGCAGAGGCTGGAGCTCAGCGACATCTACCAGATC
CFTR-C008  AGGCCCATCCTGCGCAAGGGGTACCGGCAGAGGCTGGAGCTGAGCGACATATACCAGATC
CFTR-C033  AGGCCCATCCTGCGCAAGGGGTACCGGCAGAGGCTGGAGCTGAGCGACATATACCAGATC
CFTR-C022  CGCCCCATCCTGAGGAAGGGCTACCGGCAGCGCCTGGAGCTGAGCGACATCTACCAGATC
CFTR-C047  CGCCCCATCCTGAGGAAGGGCTACCGGCAGCGCCTGGAGCTGAGCGACATCTACCAGATC
CFTR-C017  CGCCCCATCCTGCGAAAGGGCTACAGGCAGCGGCTGGAACTGAGCGATATCTACCAGATC
CFTR-C042  CGCCCCATCCTGCGAAAGGGCTACAGGCAGCGGCTGGAACTGAGCGATATCTACCAGATC
CFTR-C020  AGACCCATCCTGCGGAAGGGCTACCGGCAGCGGCTCGAGCTGAGCGACATCTACCAGATC
CFTR-C045  AGACCCATCCTGCGGAAGGGCTACCGGCAGCGGCTCGAGCTGAGCGACATCTACCAGATC
CFTR-C013  AGGCCCATCCTGCGGAAGGGCTATAGGCAGCGGCTCGAGCTCAGCGACATCTATCAGATC
CFTR-C038  AGGCCCATCCTGCGGAAGGGCTATAGGCAGCGGCTCGAGCTCAGCGACATCTATCAGATC
CFTR-C002  AGGCCGATCCTGCGCAAGGGCTACAGGCAGAGGCTGGAACTGAGCGACATATACCAGATC
CFTR-C027  AGGCCGATCCTGCGCAAGGGCTACAGGCAGAGGCTGGAACTGAGCGACATATACCAGATC
CFTR-C011  CGACCCATCCTGAGAAAGGGCTATCGTCAGAGGCTGGAGCTGTCGGACATCTACCAGATC
CFTR-C036  CGACCCATCCTGAGAAAGGGCTATCGTCAGAGGCTGGAGCTGTCGGACATCTACCAGATC
CFTR-C005  AGGCCCATCCTGAGGAAGGGGTACCGGCAGAGGCTGGAGCTCAGCGACATCTATCAAATC
CFTR-C030  AGGCCCATCCTGAGGAAGGGGTACCGGCAGAGGCTGGAGCTCAGCGACATCTATCAAATC
CFTR-C006  CGCCCCATCCTGAGAAAGGGCTACCGCCAGCGGCTGGAACTGAGCGATATCTACCAGATC
CFTR-C031  CGCCCCATCCTGAGAAAGGGCTACCGCCAGCGGCTGGAACTGAGCGATATCTACCAGATC
CFTR-C018  AGGCCCATCCTGCGGAAGGGCTACCGGCAGAGGCTCGAGCTGTCCGACATTTATCAGATC
CFTR-C043  AGGCCCATCCTGCGGAAGGGCTACCGGCAGAGGCTCGAGCTGTCCGACATTTATCAGATC
CFTR-C003  AGGCCCATCCTGCGGAAAGGCTACCGCCAGCGGCTGGAGCTGAGCGACATCTATCAGATC
CFTR-C028  AGGCCCATCCTGCGGAAAGGCTACCGCCAGCGGCTGGAGCTGAGCGACATCTATCAGATC
CFTR-C016  AGGCCCATCCTCAGGAAGGGCTATCGCCAGCGGCTGGAGCTGTCCGACATCTACCAGATC
CFTR-C041  AGGCCCATCCTCAGGAAGGGCTATCGCCAGCGGCTGGAGCTGTCCGACATCTACCAGATC
CFTR-C010  CGGCCCATCCTGCGCAAGGGCTATAGGCAGAGGCTGGAGCTGAGCGATATCTACCAGATA
CFTR-C035  CGGCCCATCCTGCGCAAGGGCTATAGGCAGAGGCTGGAGCTGAGCGATATCTACCAGATA
CFTR-C012  CGACCCATCCTCCGCAAAGGGTATAGGCAGAGGCTCGAGCTGTCCGATATCTACCAGATC
CFTR-C037  CGACCCATCCTCCGCAAAGGGTATAGGCAGAGGCTCGAGCTGTCCGATATCTACCAGATC
CFTR-C009  AGGCCCATCTTAAGAAAGGGCTACAGGCAACGGCTCGAGCTGAGCGACATCTACCAGATC
CFTR-C034  AGGCCCATCTTAAGAAAGGGCTACAGGCAACGGCTCGAGCTGAGCGACATCTACCAGATC
CFTR-C015  AGGCCCATCCTGCGGAAGGGCTATAGGCAGAGGCTGGAACTGAGCGACATCTATCAGATA
CFTR-C040  AGGCCCATCCTGCGGAAGGGCTATAGGCAGAGGCTGGAACTGAGCGACATCTATCAGATA
CFTR-C019  CGTCCCATCCTGCGGAAGGGCTACCGCCAGCGCCTGGAGCTGTCCGATATATACCAGATC
CFTR-C044  CGTCCCATCCTGCGGAAGGGCTACCGCCAGCGCCTGGAGCTGTCCGATATATACCAGATC
CFTR-C007  AGGCCGATCCTGAGGAAGGGCTATCGTCAGCGTCTGGAGCTGAGCGACATCTACCAGATC
CFTR-C032  AGGCCGATCCTGAGGAAGGGCTATCGTCAGCGTCTGGAGCTGAGCGACATCTACCAGATC
CFTR-C014  CGCCCGATCCTGCGAAAGGGTATAGGCAGCGCCTGGAACTGTCCGACATCTATCAGATC
CFTR-C039  CGCCCGATCCTGCGAAAGGGTATAGGCAGCGCCTGGAACTGTCCGACATCTATCAGATC
CFTR-C025  AGGCCCATCCTCCGGAAGGGTTACCGGCAGCGGCTGGAGCTGTCCGACATCTACCAGATA
CFTR-C050  AGGCCCATCCTCCGGAAGGGTTACCGGCAGCGGCTGGAGCTGTCCGACATCTACCAGATA
CFTR-C023  CGGCCCATCCTCCGGAAGGGCTATCGGCAGAGGCTGGAGCTGAGCGACATTTACCAGATC
CFTR-C048  CGGCCCATCCTCCGGAAGGGCTATCGGCAGAGGCTGGAGCTGAGCGACATTTACCAGATC
CFTR-C024  CGGCCCATCCTGAGGAAAGGCTACAGGCAGCGACTCGAGCTGTCCGACATATACCAAATC
CFTR-C049  CGGCCCATCCTGAGGAAAGGCTACAGGCAGCGACTCGAGCTGTCCGACATATACCAAATC
            * ** **  *  * **,** **  *,** *  ,* **, *     **,** **,**,**
```

FIG. 10 (cont)

```
CFTR-WT    CCTTCTGTTGATTCTGCTGACAATCTATCTGAAAAATTGGAAAGAGAATGGGATAGAGAG
CFTR-C001  CCCAGCGTGGATAGCGCCGATAACCTGAGCGAAAAGCTCGAACGGGAGTGGGACAGGGAG
CFTR-C026  CCCAGCGTGGATAGCGCCGATAACCTGAGCGAAAAGCTCGAACGGGAGTGGGACAGGGAG
CFTR-C004  CCCTCAGTGGATTCGGCCGACAACCTGTCCGAGAAGCTGGAGAGGGAGTGGGATCGGGAG
CFTR-C029  CCCTCAGTGGATTCGGCCGACAACCTGTCCGAGAAGCTGGAGAGGGAGTGGGATCGGGAG
CFTR-C021  CCGAGCGTGGACTCGGCGGATAACCTGAGCGAGAAGCTGGAGCGAGAGTGGGACCGAGAG
CFTR-C046  CCGAGCGTGGACTCGGCGGATAACCTGAGCGAGAAGCTGGAGCGAGAGTGGGACCGAGAG
CFTR-C008  CCCTCAGTGGACAGCGCGGACAACCTGTCCGAGAAGCTGGAGCGCGAGTGGGACCGTGAG
CFTR-C033  CCCTCAGTGGACAGCGCGGACAACCTGTCCGAGAAGCTGGAGCGCGAGTGGGACCGTGAG
CFTR-C022  CCGAGCGTCGACAGCGCCGACAACCTGAGCGAGAAGCTGGAGCGGGAGTGGGATCGGGAG
CFTR-C047  CCGAGCGTCGACAGCGCCGACAACCTGAGCGAGAAGCTGGAGCGGGAGTGGGATCGGGAG
CFTR-C017  CCGAGCGTGGATAGCGCCGACAACCTGTCCGAGAAACTGGAGAGGGAGTGGGACAGGGAG
CFTR-C042  CCGAGCGTGGATAGCGCCGACAACCTGTCCGAGAAACTGGAGAGGGAGTGGGACAGGGAG
CFTR-C020  CCCTCCGTGGACAGCGCCGACAACCTGAGCGAGAAGCTGGAGCGAGAGTGGGACAGGGAG
CFTR-C045  CCCTCCGTGGACAGCGCCGACAACCTGAGCGAGAAGCTGGAGCGAGAGTGGGACAGGGAG
CFTR-C013  CCCTCGGTCGACTCCGCCGACAACCTGTCCGAGAAACTGGAGCGCGAGTGGGACAGGGAA
CFTR-C038  CCCTCGGTCGACTCCGCCGACAACCTGTCCGAGAAACTGGAGCGCGAGTGGGACAGGGAA
CFTR-C002  CCCAGCGTGGACAGCGCCGACAACCTGAGCGAGAAGCTCGAGCGCGAGTGGGACCGGGAG
CFTR-C027  CCCAGCGTGGACAGCGCCGACAACCTGAGCGAGAAGCTCGAGCGCGAGTGGGACCGGGAG
CFTR-C011  CCCTCCGTGGACAGCGCCGACAATCTCTCCGAAAAACTGGAGCGTGAGTGGGATCGCGAG
CFTR-C036  CCCTCCGTGGACAGCGCCGACAATCTCTCCGAAAAACTGGAGCGTGAGTGGGATCGCGAG
CFTR-C005  CCCAGCGTGGACTCCGCCGACAACCTGAGCGAGAAGCTCGAGAGGGAGTGGGATAGGGAG
CFTR-C030  CCCAGCGTGGACTCCGCCGACAACCTGAGCGAGAAGCTCGAGAGGGAGTGGGATAGGGAG
CFTR-C006  CCCAGCGTGGACAGCGCCGACAACCTGAGCGAAAAACTGGAAAGGGAGTGGGACCGGGAA
CFTR-C031  CCCAGCGTGGACAGCGCCGACAACCTGAGCGAAAAACTGGAAAGGGAGTGGGACCGGGAA
CFTR-C018  CCCAGCGTGGACAGCGCCGACAACCTGAGTGAGAAGCTGGAGAGGGAGTGGGACCGGGAG
CFTR-C043  CCCAGCGTGGACAGCGCCGACAACCTGAGTGAGAAGCTGGAGAGGGAGTGGGACCGGGAG
CFTR-C003  CCCTCGGTGGACAGCGCTGACAACCTCTCCGAGAAGCTGGAGCGAGAGTGGGATAGGGAG
CFTR-C028  CCCTCGGTGGACAGCGCTGACAACCTCTCCGAGAAGCTGGAGCGAGAGTGGGATAGGGAG
CFTR-C016  CCCTCGGTGGATAGCGCCGACAACCTGTCCGAGAAGCTTGAGCGGGAGTGGGATAGGGAG
CFTR-C041  CCCTCGGTGGATAGCGCCGACAACCTGTCCGAGAAGCTTGAGCGGGAGTGGGATAGGGAG
CFTR-C010  CCCTCCGTGGACAGCGCCGACAACCTGTCGGAGAAACTCGAGCGGGAGTGGGACAGGGAA
CFTR-C035  CCCTCCGTGGACAGCGCCGACAACCTGTCGGAGAAACTCGAGCGGGAGTGGGACAGGGAA
CFTR-C012  CCCTCCGTGGACAGCGCCGATAACCTCTCTGAAGCTGGAGCGGGAGTGGGACCGCGAG
CFTR-C037  CCCTCCGTGGACAGCGCCGATAACCTCTCTGAAGAAGCTGGAGCGGGAGTGGGACCGCGAG
CFTR-C009  CCGTCCGTGGACAGCGCCGACAACCTGAGCGAGAAGTTGGAACGCGAGTGGGATCGCGAG
CFTR-C034  CCGTCCGTGGACAGCGCCGACAACCTGAGCGAGAAGTTGGAACGCGAGTGGGATCGCGAG
CFTR-C015  CCCTCCGTAGACAGCGCCGACAACCTTCCGAGAAGCTGGAGAGGGAGTGGGACAGGGAG
CFTR-C040  CCCTCCGTAGACAGCGCCGACAACCTTCCGAGAAGCTGGAGAGGGAGTGGGACAGGGAG
CFTR-C019  CCCTCCGTCGATAGCGCGGACAACCTGTCCGAGAAGCTGGAGCGTGAGTGGGACCGCGAG
CFTR-C044  CCCTCCGTCGATAGCGCGGACAACCTGTCCGAGAAGCTGGAGCGTGAGTGGGACCGCGAG
CFTR-C007  CCGAGCGTCGACAGCGCGGACAACTTAAGCGAGAAGCTGGAGAGGGAGTGGGATCGGGAA
CFTR-C032  CCGAGCGTCGACAGCGCGGACAACTTAAGCGAGAAGCTGGAGAGGGAGTGGGATCGGGAA
CFTR-C014  CCGAGCGTGGACAGCGCCGACAACCTGAGCGAGAAGCTGGAGAGGGAGTGGGATAGAGAG
CFTR-C039  CCGAGCGTGGACAGCGCCGACAACCTGAGCGAGAAGCTGGAGAGGGAGTGGGATAGAGAG
CFTR-C025  CCCTCCGTGGACAGCGCCGATAACCTGAGCGAAAAGCTGGAAAGGGAATGGGACCGGGAG
CFTR-C050  CCCTCCGTGGACAGCGCCGATAACCTGAGCGAAAAGCTGGAAAGGGAATGGGACCGGGAG
CFTR-C023  CCAAGCGTCGACAGCGCCGACAACCTGAGCGAGAAGCTGGAGCGGGAGTGGGACCGTGAG
CFTR-C048  CCAAGCGTCGACAGCGCCGACAACCTGAGCGAGAAGCTGGAGCGGGAGTGGGACCGTGAG
CFTR-C024  CCCAGCGTGGACAGCGCGGACAACCTGAGCGAGAAGCTGGAGCGCGAGTGGGACAGGGAG
CFTR-C049  CCCAGCGTGGACAGCGCGGACAACCTGAGCGAGAAGCTGGAGCGCGAGTGGGACAGGGAG
           **    ** **.   ** **,**,.*    **,**,,*  **, * **,*****, *. **,
```

FIG. 10 (cont)

| | |
|---|---|
| CFTR-WT | CTGGCTTCAAAGAAAAATCCTAAACTCATTAATGCCCTTCGGCGATGTTTTTCTGGAGA |
| CFTR-C001 | CTGGCCAGCAAAAAGAACCCCAAACTGATCAACGCCTTGAGGAGGTGCTTCTTCTGGCGT |
| CFTR-C026 | CTGGCCAGCAAAAAGAACCCCAAACTGATCAACGCCTTGAGGAGGTGCTTCTTCTGGCGT |
| CFTR-C004 | CTGGCCAGCAAGAAGAACCCTAAGCTGATCAACGCCCTGAGGCGGTGCTTCTTCTGGAGG |
| CFTR-C029 | CTGGCCAGCAAGAAGAACCCTAAGCTGATCAACGCCCTGAGGCGGTGCTTCTTCTGGAGG |
| CFTR-C021 | CTGGCCAGCAAAAAGAACCCCAAGCTGATCAACGCCCTGAGACGGTGCTTCTTCTGGCGG |
| CFTR-C046 | CTGGCCAGCAAAAAGAACCCCAAGCTGATCAACGCCCTGAGACGGTGCTTCTTCTGGCGG |
| CFTR-C008 | CTGGCCAGCAAGAAGAACCCCAAGCTGATCAACGCTCTCAGGAGATGTTTCTTCTGGAGG |
| CFTR-C033 | CTGGCCAGCAAGAAGAACCCCAAGCTGATCAACGCTCTCAGGAGATGTTTCTTCTGGAGG |
| CFTR-C022 | CTCGCCTCCAAGAAAAACCCCAAGCTGATCAACGCCCTGAGGCGGTGCTTCTTCTGGCGG |
| CFTR-C047 | CTCGCCTCCAAGAAAAACCCCAAGCTGATCAACGCCCTGAGGCGGTGCTTCTTCTGGCGG |
| CFTR-C017 | CTGGCAAGCAAAAAAAATCCGAAGCTGATCAACGCCCTGAGGAGGTGCTTCTTTTGGCGG |
| CFTR-C042 | CTGGCAAGCAAAAAAAATCCGAAGCTGATCAACGCCCTGAGGAGGTGCTTCTTTTGGCGG |
| CFTR-C020 | CTGGCCAGCAAGAAAAACCCCAAGCTGATCAACGCCCTGCGCCGCTGCTTCTTCTGGCGG |
| CFTR-C045 | CTGGCCAGCAAGAAAAACCCCAAGCTGATCAACGCCCTGCGCCGCTGCTTCTTCTGGCGG |
| CFTR-C013 | CTGGCCAGCAAGAAGAATCCGAAACTGATCAACGCCCTCAGGCGCTGCTTCTTTTGGAGG |
| CFTR-C038 | CTGGCCAGCAAGAAGAATCCGAAACTGATCAACGCCCTCAGGCGCTGCTTCTTTTGGAGG |
| CFTR-C002 | CTGGCCAGCAAGAAGAACCCGAAGCTGATCAACGCCCTCAGGCGCTGCTTCTTCTGGCGG |
| CFTR-C027 | CTGGCCAGCAAGAAGAACCCGAAGCTGATCAACGCCCTCAGGCGCTGCTTCTTCTGGCGG |
| CFTR-C011 | CTGGCCTCCAAGAAGAACCCCAAGCTGATCAACGCCCTGAGGAGGTGTTTCTTCTGGAGG |
| CFTR-C036 | CTGGCCTCCAAGAAGAACCCCAAGCTGATCAACGCCCTGAGGAGGTGTTTCTTCTGGAGG |
| CFTR-C005 | CTGGCCAGCAAGAAGAATCCGAAGCTGATCAACGCCCTCAGGCGGTGCTTCTTTTGGAGG |
| CFTR-C030 | CTGGCCAGCAAGAAGAATCCGAAGCTGATCAACGCCCTCAGGCGGTGCTTCTTTTGGAGG |
| CFTR-C006 | CTGGCCAGCAAGAAGAATCCGAAACTGATCAACGCCCTCCGTCGCTGCTTCTTCTGGAGG |
| CFTR-C031 | CTGGCCAGCAAGAAGAATCCCAAACTGATCAACGCCCTCCGTCGCTGCTTCTTCTGGAGG |
| CFTR-C018 | CTGGCCAGCAAAAAAAACCCAAGCTGATCAACGCACTGAGGAGGTGCTTCTTCTGGCGT |
| CFTR-C043 | CTGGCCAGCAAAAAAAACCCAAAGCTGATCAACGCACTGAGGAGGTGCTTCTTCTGGCGT |
| CFTR-C003 | CTGGCCAGCAAGAAGAACCCAAAGCTGATCAACGCCCTGCGCAGGTGCTTTTTTGGAGG |
| CFTR-C028 | CTGGCCAGCAAGAAGAACCCAAAGCTGATCAACGCCCTGCGCAGGTGCTTTTTTGGAGG |
| CFTR-C016 | CTTGCCAGCAAGAAGAACCCGAAACTGATCAACGCCCTGAGGCGCTGCTTCTTTTGGCGC |
| CFTR-C041 | CTTGCCAGCAAGAAGAACCCGAAACTGATCAACGCCCTGAGGCGCTGCTTCTTTTGGCGC |
| CFTR-C010 | CTGGCCAGCAAGAAGAACCCGAAGCTGATCAACGCCCTCCGACGGTGTTTCTTCTGGAGG |
| CFTR-C035 | CTGGCCAGCAAGAAGAACCCGAAGCTGATCAACGCCCTCCGACGGTGTTTCTTCTGGAGG |
| CFTR-C012 | CTGGCCAGCAAGAAGAATCCCAAGCTCATCAACGCACTGAGGCGGTGCTTCTTTTGGCGG |
| CFTR-C037 | CTGGCCAGCAAGAAGAATCCCAAGCTCATCAACGCACTGAGGCGGTGCTTCTTTTGGCGG |
| CFTR-C009 | CTCGCCTCCAAGAAAAATCCCAAACTTATCAACGCGCTGAGGAGATGCTTCTTCTGGAGG |
| CFTR-C034 | CTCGCCTCCAAGAAAAATCCCAAACTTATCAACGCGCTGAGGAGATGCTTCTTCTGGAGG |
| CFTR-C015 | CTGGCCTCCAAGAAGAACCCCAAGCTCATCAACGCCCTGCGGAGATGCTTCTTTTGGAGG |
| CFTR-C040 | CTGGCCTCCAAGAAGAACCCCAAGCTCATCAACGCCCTGCGGAGATGCTTCTTTTGGAGG |
| CFTR-C019 | CTGGCCAGCAAGAAGAACCCCAAGCTGATCAACGCCCTGCGCAGGTGCTTTTTCTGGAGG |
| CFTR-C044 | CTGGCCAGCAAGAAGAACCCCAAGCTGATCAACGCCCTGCGCAGGTGCTTTTTCTGGAGG |
| CFTR-C007 | CTGGCCAGCAAAAAGAACCCCAAGCTCATCAACGCCCTGAGGCGGTGCTTCTTCTGGCGC |
| CFTR-C032 | CTGGCCAGCAAAAAGAACCCCAAGCTCATCAACGCCCTGAGGCGGTGCTTCTTCTGGCGC |
| CFTR-C014 | CTGGCCTCCAAAAAGAATCCCAAGCTCATCAACGCCTTGCGGCGATGCTTCTTTTGGAGG |
| CFTR-C039 | CTGGCCTCCAAAAAGAATCCCAAGCTCATCAACGCCTTGCGGCGATGCTTCTTTTGGAGG |
| CFTR-C025 | CTCGCCTCCAAGAAGAACCCCAAGCTGATTAACGCCCTGCGGCGGTGCTTCTTCTGGCGC |
| CFTR-C050 | CTCGCCTCCAAGAAGAACCCCAAGCTGATTAACGCCCTGCGGCGGTGCTTCTTCTGGCGC |
| CFTR-C023 | CTGGCAAGTAAGAAGAACCCCAAGCTGATAAATGCCCTGAGGCGATGTTTTTTTGGAGG |
| CFTR-C048 | CTGGCAAGTAAGAAGAACCCCAAGCTGATAAATGCCCTGAGGCGATGTTTTTTTGGAGG |
| CFTR-C024 | CTCGCCAGCAAGAAAAATCCCAAGCTTATCAACGCCCTGAGGCGTTGTTTTTCTGGCGC |
| CFTR-C049 | CTCGCCAGCAAGAAAAATCCCAAGCTTATCAACGCCCTGAGGCGTTGTTTTTCTGGCGC |
| |     ,,, ,  ,** ,*  *   *  ,,,* * |

FIG. 10 (cont)

```
CFTR-WT    TTTATGTTCTATGGAATCTTTTTATATTTAGGGGAAGTCACCAAAGCAGTACAGCCTCTC
CFTR-C001  TTCATGTTCTACGGCATCTTCCTGTACCTGGGTGAGGTAACCAAGGCCGTCCAGCCCCTG
CFTR-C026  TTCATGTTCTACGGCATCTTCCTGTACCTGGGTGAGGTAACCAAGGCCGTCCAGCCCCTG
CFTR-C004  TTCATGTTTTACGGCATCTTCCTGTATCTGGGCGAGGTGACCAAGGCCGTACAGCCCCTG
CFTR-C029  TTCATGTTTTACGGCATCTTCCTGTATCTGGGCGAGGTGACCAAGGCCGTACAGCCCCTG
CFTR-C021  TTTATGTTCTACGGCATCTTCTTGTACCTCGGGGAGGTTACCAAGGCCGTGCAGCCCCTC
CFTR-C046  TTTATGTTCTACGGCATCTTCTTGTACCTCGGGGAGGTTACCAAGGCCGTGCAGCCCCTC
CFTR-C008  TTTATGTTCTACGGCATCTTCCTGTACCTGGGGGAGGTCACCAAGGCCGTGCAGCCCCTG
CFTR-C033  TTTATGTTCTACGGCATCTTCCTGTACCTGGGGGAGGTCACCAAGGCCGTGCAGCCCCTG
CFTR-C022  TTCATGTTTTACGGCATCTTCCTGTACCTGGGAGAGGTCACGAAGGCCGTGCAGCCCTTG
CFTR-C047  TTCATGTTTTACGGCATCTTCCTGTACCTGGGAGAGGTCACGAAGGCCGTGCAGCCCTTG
CFTR-C017  TTCATGTTCTACGGGATCTTCCTGTACCTGGGCGAAGTAACCAAGGCCGTCCAGCCACTG
CFTR-C042  TTCATGTTCTACGGGATCTTCCTGTACCTGGGCGAAGTAACCAAGGCCGTCCAGCCACTG
CFTR-C020  TTCATGTTTTATGGCATCTTTCTGTACCTGGGCGAAGTGACGAAGGCCGTGCAGCCCCTG
CFTR-C045  TTCATGTTTTATGGCATCTTTCTGTACCTGGGCGAAGTGACGAAGGCCGTGCAGCCCCTG
CFTR-C013  TTCATGTTCTACGGCATATTCCTGTACCTGGGCGAGGTGACCAAGGCCGTGCAGCCCCTC
CFTR-C038  TTCATGTTCTACGGCATATTCCTGTACCTGGGCGAGGTGACCAAGGCCGTGCAGCCCCTC
CFTR-C002  TTCATGTTCTACGGCATCTTCCTGTACCTCGGGGAGGTGACAAAGGCCGTTCAGCCGCTG
CFTR-C027  TTCATGTTCTACGGCATCTTCCTGTACCTCGGGGAGGTGACAAAGGCCGTTCAGCCGCTG
CFTR-C011  TTCATGTTCTATGGCATATTCCTGTACCTGGGCGAGGTGACCAAGGCCGTCCAGCCCCTG
CFTR-C036  TTCATGTTCTATGGCATATTCCTGTACCTGGGCGAGGTGACCAAGGCCGTCCAGCCCCTG
CFTR-C005  TTCATGTTCTACGGCATCTTCCTGTACCTGGGCGAGGTGACCAAGGCCGTGCAGCCGCTG
CFTR-C030  TTCATGTTCTACGGCATCTTCCTGTACCTGGGCGAGGTGACCAAGGCCGTGCAGCCGCTG
CFTR-C006  TTTATGTTCTACGGGATATTCCTATACCTGGGGGAAGTGACCAAGGCCGTGCAGCCCCTC
CFTR-C031  TTTATGTTCTACGGGATATTCCTATACCTGGGGGAAGTGACCAAGGCCGTGCAGCCCCTC
CFTR-C018  TTTATGTTTTACGGCATCTTCCTGTATCTGGGAGAGGTCACGAAGGCCGTGCAGCCCCTG
CFTR-C043  TTTATGTTTTACGGCATCTTCCTGTATCTGGGAGAGGTCACGAAGGCCGTGCAGCCCCTG
CFTR-C003  TTCATGTTCTACGGCATCTTCCTGTACCTAGGCGAAGTGACCAAGGCCGTGCAGCCCCTG
CFTR-C028  TTCATGTTCTACGGCATCTTCCTGTACCTAGGCGAAGTGACCAAGGCCGTGCAGCCCCTG
CFTR-C016  TTCATGTTCTACGGCATTTTCCTCTACCTCGGCGAAGTGACCAAGGCCGTGCAGCCCCTT
CFTR-C041  TTCATGTTCTACGGCATTTTCCTCTACCTCGGCGAAGTGACCAAGGCCGTGCAGCCCCTT
CFTR-C010  TTCATGTTCTACGGCATCTTCCTGTATCTGGGGGAAGTGACCAAGGCCGTGCAGCCCCTG
CFTR-C035  TTCATGTTCTACGGCATCTTCCTGTATCTGGGGGAAGTGACCAAGGCCGTGCAGCCCCTG
CFTR-C012  TTCATGTTCTATGGCATCTTTCTGTACCTGGGGGAGGTCACCAAGGCCGTGCAACCCCTC
CFTR-C037  TTCATGTTCTATGGCATCTTTCTGTACCTGGGGGAGGTCACCAAGGCCGTGCAACCCCTC
CFTR-C009  TTCATGTTCTACGGCATCTTCCTGTACCTGGGAGAGGTGACCAAGGCCGTGCAGCCCCTC
CFTR-C034  TTCATGTTCTACGGCATCTTCCTGTACCTGGGAGAGGTGACCAAGGCCGTGCAGCCCCTC
CFTR-C015  TTTATGTTCTACGGCATCTTCCTGTACCTGGGCGAGGTAACTAAAGCCGTGCAGCCCCTG
CFTR-C040  TTTATGTTCTACGGCATCTTCCTGTACCTGGGCGAGGTAACTAAAGCCGTGCAGCCCCTG
CFTR-C019  TTCATGTTCTACGGGATCTTCCTGTATCTGGGCGAGGTTACCAAGGCCGTGCAACCCCTG
CFTR-C044  TTCATGTTCTACGGGATCTTCCTGTATCTGGGCGAGGTTACCAAGGCCGTGCAACCCCTG
CFTR-C007  TTCATGTTCTACGGTATCTTCCTCTACCTCGGCGAGGTCACCAAGGCCGTGCAGCCCCTG
CFTR-C032  TTCATGTTCTACGGTATCTTCCTCTACCTCGGCGAGGTCACCAAGGCCGTGCAGCCCCTG
CFTR-C014  TTTATGTTCTACGGCATCTTCCTCTACCTGGGAGAGGTGACGAAGGCCGTGCAGCCCCTC
CFTR-C039  TTTATGTTCTACGGCATCTTCCTCTACCTGGGAGAGGTGACGAAGGCCGTGCAGCCCCTC
CFTR-C025  TTCATGTTTTACGGCATCTTCCTGTACCTGGGTGAGGTGACCAAGGCCGTGCAGCCCCTG
CFTR-C050  TTCATGTTTTACGGCATCTTCCTGTACCTGGGTGAGGTGACCAAGGCCGTGCAGCCCCTG
CFTR-C023  TTCATGTTCTACGGCATCTTTCTCTACCTCGGAGAGGTGACCAAGGCCGTGCAGCCCCTG
CFTR-C048  TTCATGTTCTACGGCATCTTTCTCTACCTCGGAGAGGTGACCAAGGCCGTGCAGCCCCTG
CFTR-C024  TTCATGTTCTACGGCATCTTCCTGTACCTGGGCGAGGTGACCAAGGCCGTGCAACCCCTG
CFTR-C049  TTCATGTTCTACGGCATCTTCCTGTACCTGGGCGAGGTGACCAAGGCCGTGCAACCCCTG
           **.*****,**,** **.** **,,* **,,,* ** **,** ** **,** ** **,** ,*
```

FIG. 10 (cont)

```
CFTR-WT   TTACTGGGAAGAATCATAGCTTCCTATGACCCCGGATAACAAGGAGGAACGGTCTATCGCG
CFTR-C001 CTGCTGGGCCGTATCATCGCCAGCTATGATCCAGACAATAAGGAGGAGAGGAGCATCGCC
CFTR-C026 CTGCTGGGCCGTATCATCGCCAGCTATGATCCAGACAATAAGGAGGAGAGGAGCATCGCC
CFTR-C004 CTGCTGGGGCGGATCATCGCCAGCTACGACCCCGGATAACAAAGAGGAGAGGAGCATCGCC
CFTR-C029 CTGCTGGGGCGGATCATCGCCAGCTACGACCCCGGATAACAAAGAGGAGAGGAGCATCGCC
CFTR-C021 CTGCTCGGCCGTATCATCGCAAGCTACGATCCCGACAACAAGGAGGAAAGGAGCATCGCC
CFTR-C046 CTGCTCGGCCGTATCATCGCAAGCTACGATCCCGACAACAAGGAGGAAAGGAGCATCGCC
CFTR-C008 CTCCTGGGCCGCATCATCGCCAGCTACGACCCGGATAACAAGGAGGAAAGAAGCATCGCG
CFTR-C033 CTCCTGGGCCGCATCATCGCCAGCTACGACCCGGATAACAAGGAGGAAAGAAGCATCGCG
CFTR-C022 CTGCTGGGAAGGATCATCGCCAGCTACGACCCCGACAACAAGGAGGAAAGGTCCATTGCG
CFTR-C047 CTGCTGGGAAGGATCATCGCCAGCTACGACCCCGACAACAAGGAGGAAAGGTCCATTGCG
CFTR-C017 CTGCTGGGTAGGATCATCGCCAGCTACGACCCCGACAATAAGGAGGAAAGGAGCATCGCG
CFTR-C042 CTGCTGGGTAGGATCATCGCCAGCTACGACCCCGACAATAAGGAGGAAAGGAGCATCGCG
CFTR-C020 CTGCTGGGCCGTATTATCGCGAGCTATGATCCCGACAACAAGGAGGAGAGGAGCATCGCC
CFTR-C045 CTGCTGGGCCGTATTATCGCGAGCTATGATCCCGACAACAAGGAGGAGAGGAGCATCGCC
CFTR-C013 CTGCTGGGACGAATCATCGCCTCCTACGACCCCGATAACAAGGAGGAGCGCAGCATCGCC
CFTR-C038 CTGCTGGGACGAATCATCGCCTCCTACGACCCCGATAACAAGGAGGAGCGCAGCATCGCC
CFTR-C002 CTGCTGGGCCGTATCATCGCGAGCTACGACCCCGACAACAAGGAGGAAAGGTCCATCGCC
CFTR-C027 CTGCTGGGCCGTATCATCGCGAGCTACGACCCCGACAACAAGGAGGAAAGGTCCATCGCC
CFTR-C011 CTCCTCGGCAGGATCATCGCAAGCTACGATCCTGACAACAAGGAGGAAAGGAGCATCGCC
CFTR-C036 CTCCTCGGCAGGATCATCGCAAGCTACGATCCTGACAACAAGGAGGAAAGGAGCATCGCC
CFTR-C005 CTGCTGGGCCGGATCATCGCCAGCTACGACCCCGATAACAAGGAGGAACGGTCCATCGCC
CFTR-C030 CTGCTGGGCCGGATCATCGCCAGCTACGACCCCGATAACAAGGAGGAACGGTCCATCGCC
CFTR-C006 CTGCTGGGCAGGATCATCGCCAGCTATGACCCCGACAACAAGGAGGAAAGAAGCATAGCC
CFTR-C031 CTGCTGGGCAGGATCATCGCCAGCTATGACCCCGACAACAAGGAGGAAAGAAGCATAGCC
CFTR-C018 CTGCTGGGCAGGATCATCGCGAGCTATGACCCCGACAACAAGGAGGAAAGGAGCATCGCG
CFTR-C043 CTGCTGGGCAGGATCATCGCGAGCTATGACCCCGACAACAAGGAGGAAAGGAGCATCGCG
CFTR-C003 CTGCTGGGTCGCATCATCGCCAGCTACGACCCCGATAACAAGGAGGAGCGAAGCATCGCG
CFTR-C028 CTGCTGGGTCGCATCATCGCCAGCTACGACCCCGATAACAAGGAGGAGCGAAGCATCGCG
CFTR-C016 CTCCTGGGGAGGATCATCGCCAGTTACGATCCCGACAACAAAGAGGAGCGGAGCATAGCC
CFTR-C041 CTCCTGGGGAGGATCATCGCCAGTTACGATCCCGACAACAAAGAGGAGCGGAGCATAGCC
CFTR-C010 CTCCTGGGCCGGATTATCGCCAGCTATGACCCCGACAACAAGGAGGAGCGATCGATTGCC
CFTR-C035 CTCCTGGGCCGGATTATCGCCAGCTATGACCCCGACAACAAGGAGGAGCGATCGATTGCC
CFTR-C012 CTCCTCGGCAGGATCATCGCCTCCTATGACCCCGACAACAAAGAGGAGAGGTCCATAGCC
CFTR-C037 CTCCTCGGCAGGATCATCGCCTCCTATGACCCCGACAACAAAGAGGAGAGGTCCATAGCC
CFTR-C009 CTGCTCGGCCGCATAATAGCCAGCTACGACCCCGACAATAAGGAGGAGCGTAGCATCGCC
CFTR-C034 CTGCTCGGCCGCATAATAGCCAGCTACGACCCCGACAATAAGGAGGAGCGTAGCATCGCC
CFTR-C015 CTGCTCGGCAGGATCATCGCCAGCTACGACCCCGACAACAAGGAAGAGCGCTCCATCGCC
CFTR-C040 CTGCTCGGCAGGATCATCGCCAGCTACGACCCCGACAACAAGGAAGAGCGCTCCATCGCC
CFTR-C019 CTCCTCGGGCGCATCATCGCCAGCTACGACCCCGATAACAAGGAGGAGAGGAGCATTGCC
CFTR-C044 CTCCTCGGGCGCATCATCGCCAGCTACGACCCCGATAACAAGGAGGAGAGGAGCATTGCC
CFTR-C007 CTGCTGGGTAGGATCATAGCCAGCTATGACCCCGATAATAAGGAGGAGAGATCCATCGCC
CFTR-C032 CTGCTGGGTAGGATCATAGCCAGCTATGACCCCGATAATAAGGAGGAGAGATCCATCGCC
CFTR-C014 CTGCTGGGCAGAATCATCGCATCTTACGACCCCGACAATAAGGAGGAAAGGTCCATCGCG
CFTR-C039 CTGCTGGGCAGAATCATCGCATCTTACGACCCCGACAATAAGGAGGAAAGGTCCATCGCG
CFTR-C025 CTGCTCGGGAGGATCATCGCGTCCTACGACCCCGACAACAAGGAGGAGCGAAGCATCGCC
CFTR-C050 CTGCTCGGGAGGATCATCGCGTCCTACGACCCCGACAACAAGGAGGAGCGAAGCATCGCC
CFTR-C023 CTGCTGGGGCGGATCATCGCCAGCTACGATCCCGACAACAAGGAAGAGAGGTCCATAGCC
CFTR-C048 CTGCTGGGGCGGATCATCGCCAGCTACGATCCCGACAACAAGGAAGAGAGGTCCATAGCC
CFTR-C024 CTGCTCGGGAGGATCATAGCCTCCTACGACCCCGACAACAAGGAAGAGAGGAGCATTGCC
CFTR-C049 CTGCTCGGGAGGATCATAGCCTCCTACGACCCCGACAACAAGGAAGAGAGGAGCATTGCC
          ,* ** **  * ** ** **   ,**,**,** **,**,**,**,**,  *    ** **
```

FIG. 10 (cont)

| | |
|---|---|
| CFTR-WT | ATTTATCTAGGCATAGGCTTATGCCTTCTCTTTATTGTGAGGACACTGCTCCTACACCCA |
| CFTR-C001 | ATATACCTGGGCATCGGGCTCTGCCTCCTGTTCATCGTCCGAACCCTGCTGCTGCACCCT |
| CFTR-C026 | ATATACCTGGGCATCGGGCTCTGCCTCCTGTTCATCGTCCGAACCCTGCTGCTGCACCCT |
| CFTR-C004 | ATCTATCTGGGCATCGGCCTGTGCCTGCTCTTCATCGTGAGGACCTTGCTGCTGCACCCC |
| CFTR-C029 | ATCTATCTGGGCATCGGCCTGTGCCTGCTCTTCATCGTGAGGACCTTGCTGCTGCACCCC |
| CFTR-C021 | ATCTATCTGGGCATCGGCCTCTGCCTCCTGTTCATCGTTAGGACACTGCTGCTGCATCCC |
| CFTR-C046 | ATCTATCTGGGCATCGGCCTCTGCCTCCTGTTCATCGTTAGGACACTGCTGCTGCATCCC |
| CFTR-C008 | ATCTACCTGGGCATCGGCCTGTGCCTCCTGTTCATCGTTCGTACCCTGCTGCTGCATCCC |
| CFTR-C033 | ATCTACCTGGGCATCGGCCTGTGCCTCCTGTTCATCGTTCGTACCCTGCTGCTGCATCCC |
| CFTR-C022 | ATATATCTGGGAATCGGCCTGTGTCTGCTGTTCATCGTAAGGACCCTCCTGCTCCATCCC |
| CFTR-C047 | ATATATCTGGGAATCGGCCTGTGTCTGCTGTTCATCGTAAGGACCCTCCTGCTCCATCCC |
| CFTR-C017 | ATCTACCTGGGCATCGGCCTGTGCCTGCTGTTTATCGTCAGGACGCTGCTGCTGCACCCG |
| CFTR-C042 | ATCTACCTGGGCATCGGCCTGTGCCTGCTGTTTATCGTCAGGACGCTGCTGCTGCACCCG |
| CFTR-C020 | ATCTACCTGGGCATCGGCCTGTGCCTCCTGTTCATCGTACGCACCCTGTTACTGCACCCC |
| CFTR-C045 | ATCTACCTGGGCATCGGCCTGTGCCTCCTGTTCATCGTACGCACCCTGTTACTGCACCCC |
| CFTR-C013 | ATCTACCTGGGCATCGGCCTGTGCCTGCTGTTCATCGTGCGGACCTTACTGCTGCACCCG |
| CFTR-C038 | ATCTACCTGGGCATCGGCCTGTGCCTGCTGTTCATCGTGCGGACCTTACTGCTGCACCCG |
| CFTR-C002 | ATCTATCTGGGCATCGGCCTGTGTCTCCTTTTCATCGTGAGGACCCTGCTCCTGCACCCC |
| CFTR-C027 | ATCTATCTGGGCATCGGCCTGTGTCTCCTTTTCATCGTGAGGACCCTGCTCCTGCACCCC |
| CFTR-C011 | ATCTACCTGGGCATAGGCCTGTGCCTGCTGTTCATCGTGCGCACCCTGCTGCTGCACCCC |
| CFTR-C036 | ATCTACCTGGGCATAGGCCTGTGCCTGCTGTTCATCGTGCGCACCCTGCTGCTGCACCCC |
| CFTR-C005 | ATCTACCTGGGGATCGGCCTGTGCCTGCTGTTCATCGTGAGAACCCTCCTTCTGCACCCC |
| CFTR-C030 | ATCTACCTGGGGATCGGCCTGTGCCTGCTGTTCATCGTGAGAACCCTCCTTCTGCACCCC |
| CFTR-C006 | ATCTATCTAGGGATCGGGCTCTGCCTGCTGTTCATCGTCAGAACCCTGCTGCTCCACCCC |
| CFTR-C031 | ATCTATCTAGGGATCGGGCTCTGCCTGCTGTTCATCGTCAGAACCCTGCTGCTCCACCCC |
| CFTR-C018 | ATCTACCTGGGGATCGGCCTGTGCCTGCTCTTCATCGTGAGGACCCTCCTGCTGCACCCC |
| CFTR-C043 | ATCTACCTGGGGATCGGCCTGTGCCTGCTCTTCATCGTGAGGACCCTCCTGCTGCACCCC |
| CFTR-C003 | ATCTACCTGGGCATCGGCCTGTGCCTGCTGTTCATCGTGAGGACCCTGCTGCTGCACCCC |
| CFTR-C028 | ATCTACCTGGGCATCGGCCTGTGCCTGCTGTTCATCGTGAGGACCCTGCTGCTGCACCCC |
| CFTR-C016 | ATCTACCTCGGAATCGGCCTGTGCCTCCTGTTCATCGTGAGGACCCTGCTGCTGCACCCC |
| CFTR-C041 | ATCTACCTCGGAATCGGCCTGTGCCTCCTGTTCATCGTGAGGACCCTGCTGCTGCACCCC |
| CFTR-C010 | ATCTACCTCGGCATCGGCCTGTGCCTGCTGTTCATCGTAAGGACCCTCCTGCTACACCCG |
| CFTR-C035 | ATCTACCTCGGCATCGGCCTGTGCCTGCTGTTCATCGTAAGGACCCTCCTGCTACACCCG |
| CFTR-C012 | ATCTACCTGGGTATCGGCCTGTGCCTGCTGTTCATCGTGCGTACCCTGCTGCTGCACCCT |
| CFTR-C037 | ATCTACCTGGGTATCGGCCTGTGCCTGCTGTTCATCGTGCGTACCCTGCTGCTGCACCCT |
| CFTR-C009 | ATCTACCTGGGTATCGGGCTGTGCCTGCTGTTTATCGTGCGCACCCTCCTGCTGCATCCC |
| CFTR-C034 | ATCTACCTGGGTATCGGGCTGTGCCTGCTGTTTATCGTGCGCACCCTCCTGCTGCATCCC |
| CFTR-C015 | ATATACCTCGGCATAGGCCTGTGCCTGCTGTTCATCGTGAGGACCCTCCTCCTGCACCCC |
| CFTR-C040 | ATATACCTCGGCATAGGCCTGTGCCTGCTGTTCATCGTGAGGACCCTCCTCCTGCACCCC |
| CFTR-C019 | ATCTATCTGGGCATAGGCCTGTGCCTGCTGTTTATCGTGAGGACCCTGCTGCTGCATCCC |
| CFTR-C044 | ATCTATCTGGGCATAGGCCTGTGCCTGCTGTTTATCGTGAGGACCCTGCTGCTGCATCCC |
| CFTR-C007 | ATCTACCTCGGCATCGGGCTGTGCCTGCTGTTCATCGTGCGGACCCTCCTGCTGCATCCC |
| CFTR-C032 | ATCTACCTCGGCATCGGGCTGTGCCTGCTGTTCATCGTGCGGACCCTCCTGCTGCATCCC |
| CFTR-C014 | ATCTACCTGGGCATTGGCTGTGCCTCCTGTTTATCGTGCGGACCCTGCTGCTGCATCCC |
| CFTR-C039 | ATCTACCTGGGCATTGGGCTGTGCCTCCTGTTTATCGTGCGGACCCTGCTGCTGCATCCC |
| CFTR-C025 | ATCTATCTGGGGATCGGCTGTGCCTGCTTTTCATCGTCCGAACACTGCTGCTGCACCCC |
| CFTR-C050 | ATCTATCTGGGGATCGGCTGTGCCTGCTTTTCATCGTCCGAACACTGCTGCTGCACCCC |
| CFTR-C023 | ATTTACCTGGGCATCGGGCTCTGCCTCCTCTTCATCGTCCGCACCCTGCTGCTGCACCCC |
| CFTR-C048 | ATTTACCTGGGCATCGGGCTCTGCCTCCTCTTCATCGTCCGCACCCTGCTGCTGCACCCC |
| CFTR-C024 | ATCTACCTGGGCATCGGCCTGTGCCTGCTGTTCATCGTGAGGACACTGCTGCTGCACCCC |
| CFTR-C049 | ATCTACCTGGGCATCGGCCTGTGCCTGCTGTTCATCGTGAGGACACTGCTGCTGCACCCC |
| |  , .     ,*     , , *. ** ,* ,*  ,** |

FIG. 10 (cont)

```
CFTR-WT   GCCATTTTTGGCCTTCATCACATTGGAATGCAGATGAGAATAGCTATGTTTAGTTTGATT
CFTR-C001 GCCATCTTTGGGCTGCACCACATCGGCATGCAGATGAGGATCGCCATGTTTTCCCTGATC
CFTR-C026 GCCATCTTTGGGCTGCACCACATCGGCATGCAGATGAGGATCGCCATGTTTTCCCTGATC
CFTR-C004 GCCATCTTCGGCCTGCACCACATCGGCATGCAGATGAGGATCGCTATGTTCTCCCTGATC
CFTR-C029 GCCATCTTCGGCCTGCACCACATCGGCATGCAGATGAGGATCGCTATGTTCTCCCTGATC
CFTR-C021 GCCATTTTCGGCCTGCACCACATCGGGATGCAGATGAGGATCGCCATGTTTTCCCTGATC
CFTR-C046 GCCATTTTCGGCCTGCACCACATCGGGATGCAGATGAGGATCGCCATGTTTTCCCTGATC
CFTR-C008 GCCATCTTCGGCCTACACCACATAGGCATGCAGATGAGGATCGCCATGTTCTCCCTCATC
CFTR-C033 GCCATCTTCGGCCTACACCACATAGGCATGCAGATGAGGATCGCCATGTTCTCCCTCATC
CFTR-C022 GCCATCTTCGGGCTCCACCACATCGGCATGCAGATGAGGATCGCCATGTTTAGCCTCATC
CFTR-C047 GCCATCTTCGGGCTCCACCACATCGGCATGCAGATGAGGATCGCCATGTTTAGCCTCATC
CFTR-C017 GCCATCTTCGGGCTCCACCACATCGGGATGCAGATGCGAATCGCCATGTTCAGCCTGATC
CFTR-C042 GCCATCTTCGGGCTCCACCACATCGGGATGCAGATGCGAATCGCCATGTTCAGCCTGATC
CFTR-C020 GCCATCTTCGGCCTGCACCACATTGGGATGCAGATGCGGATCGCCATGTTCAGCCTGATC
CFTR-C045 GCCATCTTCGGCCTGCACCACATTGGGATGCAGATGCGGATCGCCATGTTCAGCCTGATC
CFTR-C013 GCCATCTTCGGGCTGCACCACATCGGCATGCAGATGAGGATCGCAATGTTCAGCCTGATC
CFTR-C038 GCCATCTTCGGGCTGCACCACATCGGCATGCAGATGAGGATCGCAATGTTCAGCCTGATC
CFTR-C002 GCCATCTTCGGCCTGCATCACATTGGCATGCAGATGAGGATAGCGATGTTCAGCCTGATA
CFTR-C027 GCCATCTTCGGCCTGCATCACATTGGCATGCAGATGAGGATAGCGATGTTCAGCCTGATA
CFTR-C011 GCCATATTCGGGCTGCACCACATCGGGATGCAGATGCGCATCGCCATGTTCAGCCTGATC
CFTR-C036 GCCATATTCGGGCTGCACCACATCGGGATGCAGATGCGCATCGCCATGTTCAGCCTGATC
CFTR-C005 GCCATCTTCGGGCTGCACCACATCGGAATGCAGATGCGGATTGCCATGTTCAGCCTGATC
CFTR-C030 GCCATCTTCGGGCTGCACCACATCGGAATGCAGATGCGGATTGCCATGTTCAGCCTGATC
CFTR-C006 GCCATCTTCGGCCTGCACCATATCGGAATGCAGATGCGCATCGCGATGTTCAGCCTGATC
CFTR-C031 GCCATCTTCGGCCTGCACCATATCGGAATGCAGATGCGCATCGCGATGTTCAGCCTGATC
CFTR-C018 GCCATCTTCGGCCTCCACCACATCGGAATGCAGATGAGGATCGCCATGTTCAGCCTGATC
CFTR-C043 GCCATCTTCGGCCTCCACCACATCGGAATGCAGATGAGGATCGCCATGTTCAGCCTGATC
CFTR-C003 GCGATCTTCGGCCTGCACCACATCGGCATGCAGATGAGGATCGCCATGTTCTCCCTGATC
CFTR-C028 GCGATCTTCGGCCTGCACCACATCGGCATGCAGATGAGGATCGCCATGTTCTCCCTGATC
CFTR-C016 GCAATCTTCGGCCTGCACCACATCGGCATGCAGATGCGGATCGCGATGTTCTCCCTGATT
CFTR-C041 GCAATCTTCGGCCTGCACCACATCGGCATGCAGATGCGGATCGCGATGTTCTCCCTGATT
CFTR-C010 GCCATCTTCGGCCTGCACCACATCGGCATGCAGATGCGGATAGCCATGTTCTCCCTGATC
CFTR-C035 GCCATCTTCGGCCTGCACCACATCGGCATGCAGATGCGGATAGCCATGTTCTCCCTGATC
CFTR-C012 GCGATATTCGGGCTGCACCACATCGGAATGCAGATGAGGATCGCGATGTTCTCCCTCATC
CFTR-C037 GCGATATTCGGGCTGCACCACATCGGAATGCAGATGAGGATCGCGATGTTCTCCCTCATC
CFTR-C009 GCCATCTTCGGCCTGCACCACATCGGCATGCAGATGCGAATCGCCATGTTTTCGCTGATC
CFTR-C034 GCCATCTTCGGCCTGCACCACATCGGCATGCAGATGCGAATCGCCATGTTTTCGCTGATC
CFTR-C015 GCAATCTTCGGCCTGCACCACATCGGTATGCAGATGAGGATCGCCATGTTCTCACTCATC
CFTR-C040 GCAATCTTCGGCCTGCACCACATCGGTATGCAGATGAGGATCGCCATGTTCTCACTCATC
CFTR-C019 GCGATCTTCGGCCTGCACCACATCGGCATGCAGATGAGGATCGCCATGTTCTCCCTGATT
CFTR-C044 GCGATCTTCGGCCTGCACCACATCGGCATGCAGATGAGGATCGCCATGTTCTCCCTGATT
CFTR-C007 GCCATCTTCGGCCTCCACCACATCGGTATGCAGATGCGTATAGCGATGTTCAGCCTGATA
CFTR-C032 GCCATCTTCGGCCTCCACCACATCGGTATGCAGATGCGTATAGCGATGTTCAGCCTGATA
CFTR-C014 GCCATCTTCGGACTCCACCATATCGGGATGCAGATGCGGATCGCAATGTTCTCACTGATC
CFTR-C039 GCCATCTTCGGACTCCACCATATCGGGATGCAGATGCGGATCGCAATGTTCTCACTGATC
CFTR-C025 GCGATCTTCGGGCTGCACCATATTGGCATGCAGATGAGGATAGCCATGTTCAGCCTGATC
CFTR-C050 GCGATCTTCGGGCTGCACCATATTGGCATGCAGATGAGGATAGCCATGTTCAGCCTGATC
CFTR-C023 GCCATCTTCGGGCTGCACCACATCGGCATGCAAATGCGCATCGCCATGTTCTCACTGATC
CFTR-C048 GCCATCTTCGGGCTGCACCACATCGGCATGCAAATGCGCATCGCCATGTTCTCACTGATC
CFTR-C024 GCCATCTTTGGACTCCACCACATCGGCATGCAGATGAGGATCGCCATGTTCTCCCTTATC
CFTR-C049 GCCATCTTTGGACTCCACCACATCGGCATGCAGATGAGGATCGCCATGTTCTCCCTTATC
          ** ** ** ** ** ** ** ** ** ***** *** * ** ** *****    *  **
```

FIG. 10 (cont)

```
CFTR-WT    TATAAGAAGACTTTAAAGCTGTCAAGCCGTGTTCTAGATAAAATAAGTATTGGACAACTT
CFTR-C001  TACAAGAAGACCCTGAAGCTGTCCTCACGGGTGCTGGATAAGATCAGCATCGGCCAGCTG
CFTR-C026  TACAAGAAGACCCTGAAGCTGTCCTCACGGGTGCTGGATAAGATCAGCATCGGCCAGCTG
CFTR-C004  TACAAGAAGACCCTGAAACTGTCGAGCAGGGTCCTGGACAAGATATCGATCGGGCAGCTG
CFTR-C029  TACAAGAAGACCCTGAAACTGTCGAGCAGGGTCCTGGACAAGATATCGATCGGGCAGCTG
CFTR-C021  TACAAGAAGACCCTGAAGCTGTCGAGCAGGGTGCTTGACAAGATCTCCATCGGCCAACTG
CFTR-C046  TACAAGAAGACCCTGAAGCTGTCGAGCAGGGTGCTTGACAAGATCTCCATCGGCCAACTG
CFTR-C008  TACAAGAAAACCCTGAAGTTGAGCAGCCGGGTGCTGGACAAAATCAGCATCGGTCAGCTG
CFTR-C033  TACAAGAAAACCCTGAAGTTGAGCAGCCGGGTGCTGGACAAAATCAGCATCGGTCAGCTG
CFTR-C022  TACAAAAAGACCCTGAAGCTGTCCTCCAGAGTGCTGGATAAGATCTCCATCGGCCAACTG
CFTR-C047  TACAAAAAGACCCTGAAGCTGTCCTCCAGAGTGCTGGATAAGATCTCCATCGGCCAACTG
CFTR-C017  TACAAGAAGACCCTGAAGCTGTCCAGCAGGGTCCTGGACAAGATCAGCATTGGCCAGCTG
CFTR-C042  TACAAGAAGACCCTGAAGCTGTCCAGCAGGGTCCTGGACAAGATCAGCATTGGCCAGCTG
CFTR-C020  TACAAGAAGACCCTGAAGCTGAGTTCCAGGGTGCTGGACAAGATCAGCATAGGCCAGCTG
CFTR-C045  TACAAGAAGACCCTGAAGCTGAGTTCCAGGGTGCTGGACAAGATCAGCATAGGCCAGCTG
CFTR-C013  TACAAGAAGACCCTGAAGCTCTCTAGCCGCGTGCTCGACAAGATCAGCATAGGCCAACTG
CFTR-C038  TACAAGAAGACCCTGAAGCTCTCTAGCCGCGTGCTCGACAAGATCAGCATAGGCCAACTG
CFTR-C002  TACAAGAAAACACTGAAGCTCTCCTCCAGGGTCCTGGACAAGATCAGCATCGGGCAGCTG
CFTR-C027  TACAAGAAAACACTGAAGCTCTCCTCCAGGGTCCTGGACAAGATCAGCATCGGGCAGCTG
CFTR-C011  TACAAGAAGACTCTGAAGCTGTCCAGTCGGGTGCTGGACAAAATCTCCATAGGACAGCTG
CFTR-C036  TACAAGAAGACTCTGAAGCTGTCCAGTCGGGTGCTGGACAAAATCTCCATAGGACAGCTG
CFTR-C005  TATAAAAAAACTCTGAAGCTCAGCAGCAGGGTGCTGGACAAGATAAGCATCGGCCAGCTG
CFTR-C030  TATAAAAAAACTCTGAAGCTCAGCAGCAGGGTGCTGGACAAGATAAGCATCGGCCAGCTG
CFTR-C006  TACAAGAAAACCCTGAAACTGAGCAGCAGGGTTCTGGACAAGATCTCCATCGGGCAGCTG
CFTR-C031  TACAAGAAAACCCTGAAACTGAGCAGCAGGGTTCTGGACAAGATCTCCATCGGGCAGCTG
CFTR-C018  TACAAAAAGACCCTCAAGCTGTCCTCCAGGGTGCTGGATAAGATCAGCATCGGCCAGCTG
CFTR-C043  TACAAAAAGACCCTCAAGCTGTCCTCCAGGGTGCTGGATAAGATCAGCATCGGCCAGCTG
CFTR-C003  TACAAGAAGACCCTCAAGCTCAGCAGCCGGGTGCTGGACAAGATCTCCATAGGTCAGCTC
CFTR-C028  TACAAGAAGACCCTCAAGCTCAGCAGCCGGGTGCTGGACAAGATCTCCATAGGTCAGCTC
CFTR-C016  TACAAGAAGACCCTGAAGCTGAGCAGCCGCGTGCTGGACAAGATCAGCATAGGCCAACTG
CFTR-C041  TACAAGAAGACCCTGAAGCTGAGCAGCCGCGTGCTGGACAAGATCAGCATAGGCCAACTG
CFTR-C010  TACAAGAAGACGCTGAAGCTTAGCAGCCGGGTGCTGGACAAGATCAGCATAGGCCAGCTG
CFTR-C035  TACAAGAAGACGCTGAAGCTTAGCAGCCGGGTGCTGGACAAGATCAGCATAGGCCAGCTG
CFTR-C012  TATAAGAAGACCCTGAAGCTGAGCAGCAGGGTGCTCGACAAGATCAGCATCGGACAGCTG
CFTR-C037  TATAAGAAGACCCTGAAGCTGAGCAGCAGGGTGCTCGACAAGATCAGCATCGGACAGCTG
CFTR-C009  TACAAAAAAACCCTGAAGCTGTCAAGCAGGGTGCTGGATAAGATCAGCATCGGCCAGCTG
CFTR-C034  TACAAAAAAACCCTGAAGCTGTCAAGCAGGGTGCTGGATAAGATCAGCATCGGCCAGCTG
CFTR-C015  TACAAGAAAACGCTGAAGCTGTCCTCCAGGGTGCTTGACAAGATCAGCATCGGACAGCTG
CFTR-C040  TACAAGAAAACGCTGAAGCTGTCCTCCAGGGTGCTTGACAAGATCAGCATCGGACAGCTG
CFTR-C019  TACAAAAAGACCCTGAAACTGAGCTCCGCGTGCTCGACAAGATCTCCATCGGCAACTG
CFTR-C044  TACAAAAAGACCCTGAAACTGAGCTCCCGCGTGCTCGACAAGATCTCCATCGGGCAACTG
CFTR-C007  TACAAAAAGACCCTGAAACTGAGCTCCAGGGTGCTGGATAAAATCAGCATCGGCCAGCTG
CFTR-C032  TACAAAAAGACCCTGAAACTGAGCTCCAGGGTGCTGGATAAAATCAGCATCGGCCAGCTG
CFTR-C014  TACAAGAAGACCCTGAAGCTCTCCAGCCGGGTGCTGGACAAGATAAGCATCGGCCAGCTG
CFTR-C039  TACAAGAAGACCCTGAAGCTCTCCAGCCGGGTGCTGGACAAGATAAGCATCGGCCAGCTG
CFTR-C025  TATAAAAAGACCCTGAAACTGAGCTCCAGGGTGCTCGACAAGATCAGCATCGGCCAGCTG
CFTR-C050  TATAAAAAGACCCTGAAACTGAGCTCCAGGGTGCTCGACAAGATCAGCATCGGCCAGCTG
CFTR-C023  TACAAAAAGACGCTGAAGCTGAGCAGCAGGGTGCTGGACAAGATCTCCATCGGCAACTG
CFTR-C048  TACAAAAAGACGCTGAAGCTGAGCAGCAGGGTGCTGGACAAGATCTCCATCGGCAACTG
CFTR-C024  TACAAGAAAACCCTGAAGCTCAGCAGCAGGGTGCTGGACAAGATCAGCATCGGCCAGCTC
CFTR-C049  TACAAGAAAACCCTGAAGCTCAGCAGCAGGGTGCTGGACAAGATCAGCATCGGCCAGCTC
           **,**,**,**, ,* **,,*      * ** ** **,**,**   ** ** **,**
```

FIG. 10 (cont)

| | |
|---|---|
| CFTR-WT | GTTAGTCTCCTTTCCAACAACCTGAACAAATTTGATGAAGGACTTGCATTGGCACATTTC |
| CFTR-C001 | GTGTCCCTGCTGAGCAACAACCTGAACAAGTTCGATGAGGGTCTGGCGCTGGCCCACTTC |
| CFTR-C026 | GTGTCCCTGCTGAGCAACAACCTGAACAAGTTCGATGAGGGTCTGGCGCTGGCCCACTTC |
| CFTR-C004 | GTTAGCCTGCTGTCCAACAACCTGAATAAGTTCGACGAGGGCCTGGCGCTGGCCCACTTC |
| CFTR-C029 | GTTAGCCTGCTGTCCAACAACCTGAATAAGTTCGACGAGGGCCTGGCGCTGGCCCACTTC |
| CFTR-C021 | GTGTCCCTGCTCTCCAACAACCTGAACAAGTTCGACGAGGGCCTGGCCCTGGCCCACTTC |
| CFTR-C046 | GTGTCCCTGCTCTCCAACAACCTGAACAAGTTCGACGAGGGCCTGGCCCTGGCCCACTTC |
| CFTR-C008 | GTGAGCCTGCTGAGCAACAACCTGAACAAGTTCGACGAAGGCCTGGCCCTCGCCCACTTC |
| CFTR-C033 | GTGAGCCTGCTGAGCAACAACCTGAACAAGTTCGACGAAGGCCTGGCCCTCGCCCACTTC |
| CFTR-C022 | GTGTCCCTCCTGAGCAACAACCTGAACAAGTTCGACGAGGCCTGGCCCTGGCCCATTTC |
| CFTR-C047 | GTGTCCCTCCTGAGCAACAACCTGAACAAGTTCGACGAGGGCCTGGCCCTGGCCCATTTC |
| CFTR-C017 | GTGAGCCTGCTGTCCAACAATCTGAACAAATTCGACGAGGGCCTGGCCCTGGCGCATTTC |
| CFTR-C042 | GTGAGCCTGCTGTCCAACAATCTGAACAAATTCGACGAGGGCCTGGCCCTGGCGCATTTC |
| CFTR-C020 | GTGTCCCTGCTCAGCAACAACCTCAACAAGTTTGATGAGGGCCTGGCCCTAGCCCATTTC |
| CFTR-C045 | GTGTCCCTGCTCAGCAACAACCTCAACAAGTTTGATGAGGGCCTGGCCCTAGCCCATTTC |
| CFTR-C013 | GTGAGCCTGCTGAGCAACAACTTGAACAAGTTCGATGAGGGCCTGGCCCTGGCCCACTTC |
| CFTR-C038 | GTGAGCCTGCTGAGCAACAACTTGAACAAGTTCGATGAGGGCCTGGCCCTGGCCCACTTC |
| CFTR-C002 | GTGTCCCTGCTGAGCAACAACCTGAACAAGTTCGACGAGGGCCTCGCCCTGGCCCACTTC |
| CFTR-C027 | GTGTCCCTGCTGAGCAACAACCTGAACAAGTTCGACGAGGGCCTCGCCCTGGCCCACTTC |
| CFTR-C011 | GTGTCGCTGCTGAGCAACAACCTGAATAAGTTTGACGAGGGGCTGGCCCTGGCCCATTTC |
| CFTR-C036 | GTGTCGCTGCTGAGCAACAACCTGAATAAGTTTGACGAGGGGCTGGCCCTGGCCCATTTC |
| CFTR-C005 | GTGAGCCTGCTGAGCAATAACCTGAACAAATTCGACGAGGGCCTGGCCCTGGCCCACTTC |
| CFTR-C030 | GTGAGCCTGCTGAGCAATAACCTGAACAAATTCGACGAGGGCCTGGCCCTGGCCCACTTC |
| CFTR-C006 | GTGAGCCTGCTGTCCAACAACCTGAACAAATTCGACGAGGGGCTGGCCCTCGCACATTTC |
| CFTR-C031 | GTGAGCCTGCTGTCCAACAACCTGAACAAATTCGACGAGGGGCTGGCCCTCGCACATTTC |
| CFTR-C018 | GTGAGCCTGCTGAGCAACAACCTGAACAAGTTCGACGAGGGCCTGGCGCTGGCCCACTTC |
| CFTR-C043 | GTGAGCCTGCTGAGCAACAACCTGAACAAGTTCGACGAGGGCCTGGCGCTGGCCCACTTC |
| CFTR-C003 | GTGAGCCTGCTGTCCAATAACCTGAACAAGTTCGACGAAGGCCTCGCGCTGGCGCATTTC |
| CFTR-C028 | GTGAGCCTGCTGTCCAATAACCTGAACAAGTTCGACGAAGGCCTCGCGCTGGCGCATTTC |
| CFTR-C016 | GTGTCCCTGCTCTCCAACAACCTGAACAAGTTCGACGAGGGCCTCGCCTTGGCCCACTTC |
| CFTR-C041 | GTGTCCCTGCTCTCCAACAACCTGAACAAGTTCGACGAGGGCCTCGCCTTGGCCCACTTC |
| CFTR-C010 | GTGAGCCTGCTGAGCAACAATCTGAATAAGTTCGACGAGGGACTGGCCCTCGCGCATTTC |
| CFTR-C035 | GTGAGCCTGCTGAGCAACAATCTGAATAAGTTCGACGAGGGACTGGCCCTCGCGCATTTC |
| CFTR-C012 | GTGTCGCTGCTGTCCAACAACCTAAACAAGTTCGATGAGGGGCTGGCCCTCGCCCATTTC |
| CFTR-C037 | GTGTCGCTGCTGTCCAACAACCTAAACAAGTTCGATGAGGGGCTGGCCCTCGCCCATTTC |
| CFTR-C009 | GTGTCACTGCTGAGCAACAATCTGAACAAGTTCGACGAGGGCCTGGCCCTGGCCCATTTC |
| CFTR-C034 | GTGTCACTGCTGAGCAACAATCTGAACAAGTTCGACGAGGGCCTGGCCCTGGCCCATTTC |
| CFTR-C015 | GTGAGCCTGCTCAGCAACAATCTGAACAAGTTCGACGAGGGCCTGGCCCTGGCCCATTTC |
| CFTR-C040 | GTGAGCCTGCTCAGCAACAATCTGAACAAGTTCGACGAGGGCCTGGCCCTGGCCCATTTC |
| CFTR-C019 | GTGTCCCTGCTGTCGAATAACCTGAACAAGTTTGACGAGGGGCTGGCCCTTGCCCACTTT |
| CFTR-C044 | GTGTCCCTGCTGTCGAATAACCTGAACAAGTTTGACGAGGGGCTGGCCCTTGCCCACTTT |
| CFTR-C007 | GTGAGCCTGCTGTCCAACAATCTGAACAAATTTGACGAGGGCCTGGCCCTGGCCCATTTC |
| CFTR-C032 | GTGAGCCTGCTGTCCAACAATCTGAACAAATTTGACGAGGGCCTGGCCCTGGCCCATTTC |
| CFTR-C014 | GTGTCCCTGCTGAGCAACAACCTGAATAAGTTCGACGAGGGGCTGGCCCTGGCCCATTTC |
| CFTR-C039 | GTGTCCCTGCTGAGCAACAACCTGAATAAGTTCGACGAGGGGCTGGCCCTGGCCCATTTC |
| CFTR-C025 | GTGAGCCTCCTGTCCAACAACCTGAACAAGTTCGACGAGGGCCTCGCCCTGGCCCACTTT |
| CFTR-C050 | GTGAGCCTCCTGTCCAACAACCTGAACAAGTTCGACGAGGGCCTCGCCCTGGCCCACTTT |
| CFTR-C023 | GTGAGCCTCCTGTCCAACAACCTGAACAAGTTCGACGAGGGACTGGCCCTGGCCCACTTC |
| CFTR-C048 | GTGAGCCTCCTGTCCAACAACCTGAACAAGTTCGACGAGGGACTGGCCCTGGCCCACTTC |
| CFTR-C024 | GTGAGCCTCCTGAGCAATAACCTGAACAAGTTCGACGAAGGCCTCGCCCTAGCCCACTTC |
| CFTR-C049 | GTGAGCCTCCTGAGCAATAACCTGAACAAGTTCGACGAAGGCCTCGCCCTAGCCCACTTC |
| |    ,**,,* ,,,,,,  ** ,*  ,**. |

FIG. 10 (cont)

```
CFTR-WT   GTGTGGATCGCTCCTTTGCAAGTGGCACTCCTCATGGGGCTAATCTGGGAGTTGTTACAG
CFTR-C001 GTGTGGATCGCCCCCCTGCAGGTGGCCCTGCTAATGGGCCTGATCTGGGAGCTGCTGCAG
CFTR-C026 GTGTGGATCGCCCCCCTGCAGGTGGCCCTGCTAATGGGCCTGATCTGGGAGCTGCTGCAG
CFTR-C004 GTGTGGATCGCCCCCCTGCAGGTCGCGCTGCTGATGGGCCTGATCTGGGAACTGCTACAA
CFTR-C029 GTGTGGATCGCCCCCCTGCAGGTCGCGCTGCTGATGGGCCTGATCTGGGAACTGCTACAA
CFTR-C021 GTGTGGATCGCCCCCCTGCAGGTGGCGCTGCTGATGGGGCTGATTTGGGAGCTGCTGCAG
CFTR-C046 GTGTGGATCGCCCCCCTGCAGGTGGCGCTGCTGATGGGGCTGATTTGGGAGCTGCTGCAG
CFTR-C008 GTGTGGATAGCTCCCTTGCAGGTCGCCCTGCTGATGGGACTGATCTGGGAGCTGCTGCAG
CFTR-C033 GTGTGGATAGCTCCCTTGCAGGTCGCCCTGCTGATGGGACTGATCTGGGAGCTGCTGCAG
CFTR-C022 GTGTGGATCGCCCCCCTCCAGGTGGCGCTCCTGATGGGCCTGATCTGGGAGCTGCTGCAG
CFTR-C047 GTGTGGATCGCCCCCCTCCAGGTGGCGCTCCTGATGGGCCTGATCTGGGAGCTGCTGCAG
CFTR-C017 GTGTGGATCGCCCCCCTGCAAGTGGCCCTGCTGATGGGCCTGATCTGGGAGCTGCTGCAG
CFTR-C042 GTGTGGATCGCCCCCCTGCAAGTGGCCCTGCTGATGGGCCTGATCTGGGAGCTGCTGCAG
CFTR-C020 GTGTGGATCGCCCCGCTGCAGGTGGCCCTGCTGATGGGCCTGATCTGGGAGCTGCTGCAA
CFTR-C045 GTGTGGATCGCCCCGCTGCAGGTGGCCCTGCTGATGGGCCTGATCTGGGAGCTGCTGCAA
CFTR-C013 GTTTGGATCGCCCCCCTTCAAGTGGCGCTGCTTATGGGCCTGATCTGGGAGCTGCTGCAG
CFTR-C038 GTTTGGATCGCCCCCCTTCAAGTGGCGCTGCTTATGGGCCTGATCTGGGAGCTGCTGCAG
CFTR-C002 GTCTGGATCGCCCCCCTGCAAGTGGCCCTGCTGATGGGCCTGATCTGGGAGCTGCTCCAG
CFTR-C027 GTCTGGATCGCCCCCCTGCAAGTGGCCCTGCTGATGGGCCTGATCTGGGAGCTGCTCCAG
CFTR-C011 GTGTGGATCGCCCCCCTGCAAGTCGCCCTGCTGATGGGCCTGATCTGGGAGCTCCTGCAG
CFTR-C036 GTGTGGATCGCCCCCCTGCAAGTCGCCCTGCTGATGGGCCTGATCTGGGAGCTCCTGCAG
CFTR-C005 GTGTGGATCGCCCCCCTGCAAGTCGCCCTGCTGATGGGCCTCATCTGGGAACTCCTGCAG
CFTR-C030 GTGTGGATCGCCCCCCTGCAAGTCGCCCTGCTGATGGGCCTCATCTGGGAACTCCTGCAG
CFTR-C006 GTTTGGATCGCCCCGCTCCAGGTGGCCCTGCTGATGGGCCTGATATGGGAGCTGCTGCAG
CFTR-C031 GTTTGGATCGCCCCGCTCCAGGTGGCCCTGCTGATGGGCCTGATATGGGAGCTGCTGCAG
CFTR-C018 GTGTGGATCGCCCCGCTCCAGGTCGCCCTGCTGATGGGACTGATCTGGGAACTCCTGCAG
CFTR-C043 GTGTGGATCGCCCCGCTCCAGGTCGCCCTGCTGATGGGACTGATCTGGGAACTCCTGCAG
CFTR-C003 GTGTGGATCGCCCCGCTGCAGGTGGCTCTGCTTATGGGCCTGATCTGGGAGCTGCTGCAG
CFTR-C028 GTGTGGATCGCCCCGCTGCAGGTGGCTCTGCTTATGGGCCTGATCTGGGAGCTGCTGCAG
CFTR-C016 GTGTGGATCGCCCCGCTGCAGGTCGCCCTGCTGATGGGCCTGATATGGGAGCTGCTGCAG
CFTR-C041 GTGTGGATCGCCCCGCTGCAGGTCGCCCTGCTGATGGGCCTGATATGGGAGCTGCTGCAG
CFTR-C010 GTGTGGATCGCCCCCCTGCAGGTGGCTCTGCTGATGGGCCTGATCTGGGAGCTGCTCCAG
CFTR-C035 GTGTGGATCGCCCCCCTGCAGGTGGCTCTGCTGATGGGCCTGATCTGGGAGCTGCTCCAG
CFTR-C012 GTGTGGATCGCCCCCCTGCAAGTGGCCTTGCTAATGGGCCTCATCTGGGAGCTGCTGCAG
CFTR-C037 GTGTGGATCGCCCCCCTGCAAGTGGCCTTGCTAATGGGCCTCATCTGGGAGCTGCTGCAG
CFTR-C009 GTGTGGATCGCCCCCCTCCAGGTGGCGCTGCTGATGGGCCTCATCTGGGAGCTGCTGCAG
CFTR-C034 GTGTGGATCGCCCCCCTCCAGGTGGCGCTGCTGATGGGCCTCATCTGGGAGCTGCTGCAG
CFTR-C015 GTGTGGATCGCCCCCCTGCAGGTCGCCCTGCTGATGGGCCTCATCTGGGAGCTGCTGCAG
CFTR-C040 GTGTGGATCGCCCCCCTGCAGGTCGCCCTGCTGATGGGCCTCATCTGGGAGCTGCTGCAG
CFTR-C019 GTCTGGATCGCCCCGCTCCAGGTGGCCCTCCTGATGGGGCTCATCTGGGAGCTGCTGCAG
CFTR-C044 GTCTGGATCGCCCCGCTCCAGGTGGCCCTCCTGATGGGGCTCATCTGGGAGCTGCTGCAG
CFTR-C007 GTCTGGATCGCCCCCCTGCAGGTGGCCCTCCTCATGGGCCTGATCTGGGAGCTGCTGCAG
CFTR-C032 GTCTGGATCGCCCCCCTGCAGGTGGCCCTCCTCATGGGCCTGATCTGGGAGCTGCTGCAG
CFTR-C014 GTGTGGATCGCCCCCCTGCAAGTGGCACTGCTGATGGGCCTGATCTGGGAGCTGCTGCAG
CFTR-C039 GTGTGGATCGCCCCCCTGCAAGTGGCACTGCTGATGGGCCTGATCTGGGAGCTGCTGCAG
CFTR-C025 GTGTGGATTGCCCCCCTGCAGGTGGCGCTGCTGATGGGGCTGATCTGGGAGCTGCTGCAG
CFTR-C050 GTGTGGATTGCCCCCCTGCAGGTGGCGCTGCTGATGGGGCTGATCTGGGAGCTGCTGCAG
CFTR-C023 GTGTGGATCGCCCCCCTCCAGGTGGCCCTGCTGATGGGGCTCATATGGAGCTTCTGCAG
CFTR-C048 GTGTGGATCGCCCCCCTCCAGGTGGCCCTGCTGATGGGGCTCATATGGAGCTTCTGCAG
CFTR-C024 GTGTGGATCGCGCCCCTGCAGGTGGCCCTGCTGATGGGCCTGATCTGGGAGCTGCTGCAA
CFTR-C049 GTGTGGATCGCGCCCCTGCAGGTGGCCCTGCTGATGGGCCTGATCTGGGAGCTGCTGCAA
          ** *****.**.**..*.**.**.** .* ** ***** **.**.*****..*..* **.
```

FIG. 10 (cont)

```
CFTR-WT    GCGTCTGCCTTCTGTGGACTTGGTTTCCTGATAGTCCTTGCCCTTTTTCAGGCTGGGCTA
CFTR-C001  GCCAGCGCCTTCTGCGGCCTGGGCTTCCTGATCGTGCTGGCCCTGTTCCAGGCCGGGCTG
CFTR-C026  GCCAGCGCCTTCTGCGGCCTGGGCTTCCTGATCGTGCTGGCCCTGTTCCAGGCCGGGCTG
CFTR-C004  GCCTCCGCCTTCTGCGGCCTGGGCTTTCTGATCGTGCTGGCCCTGTTCCAGGCCGGCCTC
CFTR-C029  GCCTCCGCCTTCTGCGGCCTGGGCTTTCTGATCGTGCTGGCCCTGTTCCAGGCCGGCCTC
CFTR-C021  GCCAGCGCCTTCTGCGGGCTGGGCTTTCTCATTGTGTTGGCCCTGTTCCAGGCCGGCCTC
CFTR-C046  GCCAGCGCCTTCTGCGGGCTGGGCTTTCTCATTGTGTTGGCCCTGTTCCAGGCCGGCCTC
CFTR-C008  GCCTCCGCCTTCTGCGGGCTGGGCTTCCTGATCGTGCTGGCCCTGTTCCAAGCCGGCCTG
CFTR-C033  GCCTCCGCCTTCTGCGGCCTGGGCTTCCTGATCGTGCTGGCCCTGTTCCAAGCCGGCCTG
CFTR-C022  GCCAGCGCCTTTTGCGGACTGGGGTTTCTGATCGTTTTGGCCCTGTTCCAGGCCGGACTG
CFTR-C047  GCCAGCGCCTTTTGCGGACTGGGGTTTCTGATCGTTTTGGCCCTGTTCCAGGCCGGACTG
CFTR-C017  GCCAGCGCCTTTTGCGGCCTGGGGTTCCTGATCGTGCTGGCCCTGTTCCAGGCCGGGCTC
CFTR-C042  GCCAGCGCCTTTTGCGGCCTGGGGTTCCTGATCGTGCTGGCCCTGTTCCAGGCCGGGCTC
CFTR-C020  GCCAGCGCCTTCTGCGGCCTAGGGTTCCTGATCGTGCTGGCCCTGTTCCAGGCGGGCCTG
CFTR-C045  GCCAGCGCCTTCTGCGGCCTAGGGTTCCTGATCGTGCTGGCCCTGTTCCAGGCGGGCCTG
CFTR-C013  GCCAGCGCCTTCTGCGGCCTCGGGTTCCTGATAGTGCTGGCCCTGTTCCAGGCGGGGCTC
CFTR-C038  GCCAGCGCCTTCTGCGGCCTCGGGTTCCTGATAGTGCTGGCCCTGTTCCAGGCGGGGCTC
CFTR-C002  GCGAGCGCCTTTTGCGGGCTGGGCTTCCTGATCGTGCTGGCCCTATTCCAGGCGGGCCTG
CFTR-C027  GCGAGCGCCTTTTGCGGGCTGGGCTTCCTGATCGTGCTGGCCCTATTCCAGGCGGGCCTG
CFTR-C011  GCCAGCGCCTTTTGCGGCCTGGGGTTCCTCATCGTCCTGGCCCTGTTCCAGGCAGGCCTG
CFTR-C036  GCCAGCGCCTTTTGCGGCCTGGGGTTCCTCATCGTCCTGGCCCTGTTCCAGGCAGGCCTG
CFTR-C005  GCCTCTGCCTTCTGCGGGCTGGGCTTCCTGATCGTGCTGGCCCTGTTTCAAGCTGGGCTG
CFTR-C030  GCCTCTGCCTTCTGCGGGCTGGGCTTCCTGATCGTGCTGGCCCTGTTTCAAGCTGGGCTG
CFTR-C006  GCCTCCGCCTTCTGCGGCCTGGGGTTCCTCATCGTCCTGGCCCTGTTCCAGGCCGGGCTG
CFTR-C031  GCCTCCGCCTTCTGCGGCCTGGGGTTCCTCATCGTCCTGGCCCTGTTCCAGGCCGGGCTG
CFTR-C018  GCCAGCGCCTTCTGCGGCCTGGGATTCCTCATCGTGCTGGCCCTGTTCCAGGCTGGCCTC
CFTR-C043  GCCAGCGCCTTCTGCGGCCTGGGATTCCTCATCGTGCTGGCCCTGTTCCAGGCTGGCCTC
CFTR-C003  GCCAGCGCCTTCTGCGGCCTCGGGTTCCTGATCGTGCTGGCCCTGTTCCAAGCCGGCCTC
CFTR-C028  GCCAGCGCCTTCTGCGGCCTCGGGTTCCTGATCGTGCTGGCCCTGTTCCAAGCCGGCCTC
CFTR-C016  GCCAGCGCCTTCTGTGGGCTGGGCTTCCTGATCGTGCTGGCCCTGTTCAAGCCGGCCTG
CFTR-C041  GCCAGCGCCTTCTGTGGGCTGGGCTTCCTGATCGTGCTGGCCCTGTTCAAGCCGGCCTG
CFTR-C010  GCCAGCGCCTTCTGCGGCCTCGGCTTCCTCATCGTGCTGGCCCTGTTTCAAGCCGGCCTC
CFTR-C035  GCCAGCGCCTTCTGCGGCCTCGGCTTCCTCATCGTGCTGGCCCTGTTTCAAGCCGGCCTC
CFTR-C012  GCCTCCGCCTTCTGCGGCCTGGGATTCCTGATCGTCCTGGCCCTGTTCCAGGCCGGGCTG
CFTR-C037  GCCTCCGCCTTCTGCGGCCTGGGATTCCTGATCGTCCTGGCCCTGTTCCAGGCCGGGCTG
CFTR-C009  GCGTCCGCCTTCTGCGGTCTGGGCTTCCTGATCGTGCTGGCCCTCTTTCAGGCCGGGCTC
CFTR-C034  GCGTCCGCCTTCTGCGGTCTGGGCTTCCTGATCGTGCTGGCCCTCTTTCAGGCCGGGCTC
CFTR-C015  GCCAGCGCCTTCTGCGGACTCGGCTTCCTCATCGTGCTGGCGTTTTCAAGCCGGGCTG
CFTR-C040  GCCAGCGCCTTCTGCGGACTCGGCTTCCTCATCGTGCTGGCGTTTTCAAGCCGGGCTG
CFTR-C019  GCCAGCGCCTTTTGCGGCCTGGGCTTTCTGATCGTACTCGCCCTCTTCCAGGCCGGTCTA
CFTR-C044  GCCAGCGCCTTTTGCGGCCTGGGCTTTCTGATCGTACTCGCCCTCTTCCAGGCCGGTCTA
CFTR-C007  GCCAGCGCGTTTTGCGGGCTGGGCTTCCTGATCGTGCTGGCCCTGTTTCAAGCGGGGCTG
CFTR-C032  GCCAGCGCGTTTTGCGGGCTGGGCTTCCTGATCGTGCTGGCCCTGTTTCAAGCGGGGCTG
CFTR-C014  GCTAGCGCTTTCTGCGGCCTCGGCTTCCTGATTGTCCTCGCCCTGTTCCAGGCCGGGCTG
CFTR-C039  GCTAGCGCTTTCTGCGGCCTCGGCTTCCTGATTGTCCTCGCCCTGTTCCAGGCCGGGCTG
CFTR-C025  GCCAGCGCTTTCTGCGGTCTAGGGTTCCTCATCGTGCTGGCCCTCTTCCAGGCCGGGCTG
CFTR-C050  GCCAGCGCTTTCTGCGGTCTAGGGTTCCTCATCGTGCTGGCCCTCTTCCAGGCCGGGCTG
CFTR-C023  GCCAGCGCCTTCTGTGGCCTGGGGTTTCTGATCGTGCTGGCCCTGTTTCAGGCCGGTCTC
CFTR-C048  GCCAGCGCCTTCTGTGGCCTGGGGTTTCTGATCGTGCTGGCCCTGTTTCAGGCCGGTCTC
CFTR-C024  GCCTCCGCCTTCTGCGGCCTCGGCTTTCTGATCGTGCTCGCCCTTTTCCAAGCCGGCCTC
CFTR-C049  GCCTCCGCCTTCTGCGGCCTCGGCTTTCTGATCGTGCTCGCCCTTTTCCAAGCCGGCCTC
           **  .** **.**.**  **  ** **.**  **  **  .*  **  **  ** .** ** **  **
```

FIG. 10 (cont)

| | |
|---|---|
| CFTR-WT | GGGAGAATGATGATGAAGTACAGAGATCAGAGAGCTGGGAAGATCAGTGAAAGACTTGTG |
| CFTR-C001 | GGCAGGATGATGATGAAGTACAGGGACCAGAGGGCAGGCAAGATCTCCGAGCGGCTGGTG |
| CFTR-C026 | GGCAGGATGATGATGAAGTACAGGGACCAGAGGGCAGGCAAGATCTCCGAGCGGCTGGTG |
| CFTR-C004 | GGCCGGATGATGATGAAGTACAGGGACCAGCGGGCCGGCAAGATCAGCGAGCGGCTGGTC |
| CFTR-C029 | GGCCGGATGATGATGAAGTACAGGGACCAGCGGGCCGGCAAGATCAGCGAGCGGCTGGTC |
| CFTR-C021 | GGCCGCATGATGATGAAGTACCGCGATCAGAGGGCCGGGAAGATCTCCGAGCGCCTCGTG |
| CFTR-C046 | GGCCGCATGATGATGAAGTACCGCGATCAGAGGGCCGGGAAGATCTCCGAGCGCCTCGTG |
| CFTR-C008 | GGCCGAATGATGATGAAGTACAGGGACCAACGTGCCGGGAAGATAAGCGAGAGGCTGGTT |
| CFTR-C033 | GGCCGAATGATGATGAAGTACAGGGACCAACGTGCCGGGAAGATAAGCGAGAGGCTGGTT |
| CFTR-C022 | GGCAGGATGATGATGAAGTACCGGGATCAAAGAGCGGGAAAGATCTCCGAGAGGCTGGTC |
| CFTR-C047 | GGCAGGATGATGATGAAGTACCGGGATCAAAGAGCGGGAAAGATCTCCGAGAGGCTGGTC |
| CFTR-C017 | GGTAGGATGATGATGAAGTACAGGGACCAGCGAGCCGGCAAAATCTCGGAGAGGCTGGTG |
| CFTR-C042 | GGTAGGATGATGATGAAGTACAGGGACCAGCGAGCCGGCAAAATCTCGGAGAGGCTGGTG |
| CFTR-C020 | GGCAGGATGATGATGAAGTACCGCGACCAGAGGGCTGGGAAGATCAGCGAGAGGCTGGTC |
| CFTR-C045 | GGCAGGATGATGATGAAGTACCGCGACCAGAGGGCTGGGAAGATCAGCGAGAGGCTGGTC |
| CFTR-C013 | GGCAGGATGATGATGAAGTACAGGGACCAGCGCGCCGGGAAGATCAGCGAGCGGCTGGTG |
| CFTR-C038 | GGCAGGATGATGATGAAGTACAGGGACCAGCGCGCCGGGAAGATCAGCGAGCGGCTGGTG |
| CFTR-C002 | GGCAGGATGATGATGAAGTACAGGGACCAGAGGGCCGGCAAGATATCCGAGAGGCTCGTG |
| CFTR-C027 | GGCAGGATGATGATGAAGTACAGGGACCAGAGGGCCGGCAAGATATCCGAGAGGCTCGTG |
| CFTR-C011 | GGCCGGATGATGATGAAATACAGGGACCAGAGGGCGGGCAAGATCAGCGAGAGGCTGGTG |
| CFTR-C036 | GGCCGGATGATGATGAAATACAGGGACCAGAGGGCGGGCAAGATCAGCGAGAGGCTGGTG |
| CFTR-C005 | GGCAGGATGATGATGAAGTACCGCGACCAGAGGGCCGGGAAGATCAGCGAGCGGCTGGTG |
| CFTR-C030 | GGCAGGATGATGATGAAGTACCGCGACCAGAGGGCCGGGAAGATCAGCGAGCGGCTGGTG |
| CFTR-C006 | GGCCGCATGATGATGAAGTACAGGGACCAGCGGGCCGGCAAAATCAGCGAGAGACTGGTC |
| CFTR-C031 | GGCCGCATGATGATGAAGTACAGGGACCAGCGGGCCGGCAAAATCAGCGAGAGACTGGTC |
| CFTR-C018 | GGTCGGATGATGATGAAGTACCGGGACCAGCGTGCCGGCAAGATCAGCGAAAGGCTGGTG |
| CFTR-C043 | GGTCGGATGATGATGAAGTACCGGGACCAGCGTGCCGGCAAGATCAGCGAAAGGCTGGTG |
| CFTR-C003 | GGCAGGATGATGATGAAATACAGGGATCAGAGGGCCGGCAAGATCTCAGAGAGGCTGGTG |
| CFTR-C028 | GGCAGGATGATGATGAAATACAGGGATCAGAGGGCCGGCAAGATCTCAGAGAGGCTGGTG |
| CFTR-C016 | GGCAGGATGATGATGAAGTACCGGGATCAGCGCGCCGGCAAAATCTCCGAACGGCTGGTG |
| CFTR-C041 | GGCAGGATGATGATGAAGTACCGGGATCAGCGCGCCGGCAAAATCTCCGAACGGCTGGTG |
| CFTR-C010 | GGCCGGATGATGATGAAGTACAGGGATCAGCGGGCCGGAAAGATCTCCGAGAGGCTGGTG |
| CFTR-C035 | GGCCGGATGATGATGAAGTACAGGGATCAGCGGGCCGGAAAGATCTCCGAGAGGCTGGTG |
| CFTR-C012 | GGCCGCATGATGATGAAGTACAGGGATCAGCGGGCCGGAAAGATCAGCGAGCGCCTCGTG |
| CFTR-C037 | GGCCGCATGATGATGAAGTACAGGGATCAGCGGGCCGGAAAGATCAGCGAGCGCCTCGTG |
| CFTR-C009 | GGTAGGATGATGATGAAATACAGGGACCAGAGAGCCGGCAAGATTTCAGAAAGGCTGGTG |
| CFTR-C034 | GGTAGGATGATGATGAAATACAGGGACCAGAGAGCCGGCAAGATTTCAGAAAGGCTGGTG |
| CFTR-C015 | GGCCGAATGATGATGAAGTACAGGGATCAACGGGCCGGCAAGATCTCCGAGCGGCTTGTG |
| CFTR-C040 | GGCCGAATGATGATGAAGTACAGGGATCAACGGGCCGGCAAGATCTCCGAGCGGCTTGTG |
| CFTR-C019 | GGCCGGATGATGATGAAGTACCGAGACCAACGGGCCGGCAAGATCTCCGAGAGGCTGGTC |
| CFTR-C044 | GGCCGGATGATGATGAAGTACCGAGACCAACGGGCCGGCAAGATCTCCGAGAGGCTGGTC |
| CFTR-C007 | GGCAGGATGATGATGAAGTACCGCGATCAGAGGGCCGGGAAGATTAGCGAGAGGCTCGTG |
| CFTR-C032 | GGCAGGATGATGATGAAGTACCGCGATCAGAGGGCCGGGAAGATTAGCGAGAGGCTCGTG |
| CFTR-C014 | GGCAGGATGATGATGAAGTACCGGGACCAGAGGGCAGGCAAGATAAGCGAGCGGCTGGTG |
| CFTR-C039 | GGCAGGATGATGATGAAGTACCGGGACCAGAGGGCAGGCAAGATAAGCGAGCGGCTGGTG |
| CFTR-C025 | GGGCGTATGATGATGAAGTACCGGGACCAGAGGGCGGGCAAGATAAGCGAGCGCCTGGTG |
| CFTR-C050 | GGGCGTATGATGATGAAGTACCGGGACCAGAGGGCGGGCAAGATAAGCGAGCGCCTGGTG |
| CFTR-C023 | GGCCGAATGATGATGAAGTACAGGGACCAAAGAGCGGGCAAGATCTCCGAGCGACTGGTG |
| CFTR-C048 | GGCCGAATGATGATGAAGTACAGGGACCAAAGAGCGGGCAAGATCTCCGAGCGACTGGTG |
| CFTR-C024 | GGGCGCATGATGATGAAGTACAGGGACCAGCGCGCCGGCAAGATCAGCGAGAGGCTTGTG |
| CFTR-C049 | GGGCGCATGATGATGAAGTACAGGGACCAGCGCGCCGGCAAGATCAGCGAGAGGCTTGTG |
| | ** * ********,* * .. *   .    **.*   |

FIG. 10 (cont)

| | |
|---|---|
| CFTR-WT | ATTACCTCAGAAATGATTGAAAATATCCAATCTGTTAAGGCATACTGCTGGGAAGAAGCA |
| CFTR-C001 | ATCACCTCCGAGATGATCGAGAACATCCAGAGCGTCAAGGCCTACTGCTGGGAGGAGGCC |
| CFTR-C026 | ATCACCTCCGAGATGATCGAGAACATCCAGAGCGTCAAGGCCTACTGCTGGGAGGAGGCC |
| CFTR-C004 | ATCACGAGCGAGATGATCGAGAACATCCAGAGCGTGAAGGCCTACTGCTGGGAGGAAGCC |
| CFTR-C029 | ATCACGAGCGAGATGATCGAGAACATCCAGAGCGTGAAGGCCTACTGCTGGGAGGAAGCC |
| CFTR-C021 | ATCACCTCGGAAATGATCGAGAACATCCAGAGCGTGAAGGCCTATTGTTGGGAGGAAGCC |
| CFTR-C046 | ATCACCTCGGAAATGATCGAGAACATCCAGAGCGTGAAGGCCTATTGTTGGGAGGAAGCC |
| CFTR-C008 | ATCACCAGCGAGATGATCGAGAATATTCAGTCCGTCAAGGCCTACTGTTGGGAAGAAGCC |
| CFTR-C033 | ATCACCAGCGAGATGATCGAGAATATTCAGTCCGTCAAGGCCTACTGTTGGGAAGAAGCC |
| CFTR-C022 | ATAACCAGCGAAATGATCGAGAATATCCAAAGCGTGAAGGCCTACTGCTGGGAGGAGGCC |
| CFTR-C047 | ATAACCAGCGAAATGATCGAGAATATCCAAAGCGTGAAGGCCTACTGCTGGGAGGAGGCC |
| CFTR-C017 | ATCACCTCCGAAATGATAGAGAATATTCAGTCCGTGAAGGCCTACTGCTGGGAGGAGGCC |
| CFTR-C042 | ATCACCTCCGAAATGATAGAGAATATTCAGTCCGTGAAGGCCTACTGCTGGGAGGAGGCC |
| CFTR-C020 | ATTACCTCAGAAATGATCGAGAATATCCAGTCCGTGAAGGCCTACTGCTGGGAGGAGGCC |
| CFTR-C045 | ATTACCTCAGAAATGATCGAGAATATCCAGTCCGTGAAGGCCTACTGCTGGGAGGAGGCC |
| CFTR-C013 | ATCACCTCCGAAATGATCGAGAACATCCAGAGCGTGAAGGCCTACTGCTGGGAGGAGGCC |
| CFTR-C038 | ATCACCTCCGAAATGATCGAGAACATCCAGAGCGTGAAGGCCTACTGCTGGGAGGAGGCC |
| CFTR-C002 | ATCACCAGCGAGATGATCGAGAATATCCAGTCGGTGAAGGCCTACTGCTGGGAGGAGGCC |
| CFTR-C027 | ATCACCAGCGAGATGATCGAGAATATCCAGTCGGTGAAGGCCTACTGCTGGGAGGAGGCC |
| CFTR-C011 | ATCACCTCCGAGATGATCGAGAACATCCAGTCGGTGAAGGCTTACTGCTGGGAGGAGGCC |
| CFTR-C036 | ATCACCTCCGAGATGATCGAGAACATCCAGTCGGTGAAGGCTTACTGCTGGGAGGAGGCC |
| CFTR-C005 | ATCACCAGCGAGATGATCGAGAACATCCAGTCCGTCAAGGCCTACTGCTGGGAGGAGGCC |
| CFTR-C030 | ATCACCAGCGAGATGATCGAGAACATCCAGTCCGTCAAGGCCTACTGCTGGGAGGAGGCC |
| CFTR-C006 | ATCACCAGCGAGATGATCGAGAATATCCAGAGCGTGAAAGCCTACTGCTGGGAGGAGGCC |
| CFTR-C031 | ATCACCAGCGAGATGATCGAGAATATCCAGAGCGTGAAAGCCTACTGCTGGGAGGAGGCC |
| CFTR-C018 | ATCACCTCCGAGATGATCGAAAATATACAGTCTGTGAAAGCCTACTGCTGGGAGGAGGCC |
| CFTR-C043 | ATCACCTCCGAGATGATCGAAAATATACAGTCTGTGAAAGCCTACTGCTGGGAGGAGGCC |
| CFTR-C003 | ATCACCTCCGAGATGATCGAAAATATCCAGTCCGTGAAGGCGTATTGTTGGGAAGAGGCA |
| CFTR-C028 | ATCACCTCCGAGATGATCGAAAATATCCAGTCCGTGAAGGCGTATTGTTGGGAAGAGGCA |
| CFTR-C016 | ATCACCTCGGAGATGATCGAGAATATCCAGAGCGTGAAGGCCTACTGCTGGGAGGAGGCG |
| CFTR-C041 | ATCACCTCGGAGATGATCGAGAATATCCAGAGCGTGAAGGCCTACTGCTGGGAGGAGGCG |
| CFTR-C010 | ATTACCTCCGAGATGATCGAGAACATCCAGTCCGTGAAAGCCTACTGCTGGGAAGAGGCA |
| CFTR-C035 | ATTACCTCCGAGATGATCGAGAACATCCAGTCCGTGAAAGCCTACTGCTGGGAAGAGGCA |
| CFTR-C012 | ATCACCTCCGAGATGATCGAGAACATCCAGTCCGTGAAGGCCTACTGCTGGGAGGAGGCC |
| CFTR-C037 | ATCACCTCCGAGATGATCGAGAACATCCAGTCCGTGAAGGCCTACTGCTGGGAGGAGGCC |
| CFTR-C009 | ATCACCAGCGAAATGATCGAGAACATCCAATCCGTGAAGGCCTATTGCTGGGAGGAAGCC |
| CFTR-C034 | ATCACCAGCGAAATGATCGAGAACATCCAATCCGTGAAGGCCTATTGCTGGGAGGAAGCC |
| CFTR-C015 | ATCACCAGCGAGATGATAGAGAACATCCAGAGCGTCAAGGCCTACTGCTGGGAGGAGGCC |
| CFTR-C040 | ATCACCAGCGAGATGATAGAGAACATCCAGAGCGTCAAGGCCTACTGCTGGGAGGAGGCC |
| CFTR-C019 | ATCACCAGCGAAATGATCGAGAATATCCAGAGCGTGAAAGCTTACTGTTGGGAAGAGGCC |
| CFTR-C044 | ATCACCAGCGAAATGATCGAGAATATCCAGAGCGTGAAAGCTTACTGTTGGGAAGAGGCC |
| CFTR-C007 | ATCACGAGCGAGATGATCGAGAACATCCAGAGCGTTAAGGCCTACTGCTGGGAGGAGGCG |
| CFTR-C032 | ATCACGAGCGAGATGATCGAGAACATCCAGAGCGTTAAGGCCTACTGCTGGGAGGAGGCG |
| CFTR-C014 | ATCACCTCCGAGATGATCGAGAACATTCAGAGCGTGAAGGCCTACTGCTGGGAGGAGGCA |
| CFTR-C039 | ATCACCTCCGAGATGATCGAGAACATTCAGAGCGTGAAGGCCTACTGCTGGGAGGAGGCA |
| CFTR-C025 | ATCACGTCCGAAATGATCGAGAACATCCAGTCGGTCAAGGCCTACTGTTGGGAGGAAGCC |
| CFTR-C050 | ATCACGTCCGAAATGATCGAGAACATCCAGTCGGTCAAGGCCTACTGTTGGGAGGAAGCC |
| CFTR-C023 | ATCACCTCCGAGATGATCGAGAACATCCAGTCGGTGAAAGCCTACTGCTGGGAGGAGGCC |
| CFTR-C048 | ATCACCTCCGAGATGATCGAGAACATCCAGTCGGTGAAAGCCTACTGCTGGGAGGAGGCC |
| CFTR-C024 | ATCACCAGCGAGATGATCGAGAACATCCAGTCTGTCAAAGCCTACTGCTGGGAGGAGGCC |
| CFTR-C049 | ATCACCAGCGAGATGATCGAGAACATCCAGTCTGTCAAAGCCTACTGCTGGGAGGAGGCC |
| |   .* ..   . . *** ..** |

FIG. 10 (cont)

| | |
|---|---|
| CFTR-WT | ATGGAAAAAATGATTGAAAACTTAAGACAAACAGAACTGAAACTGACTCGGAAGGCAGCC |
| CFTR-C001 | ATGGAGAAGATGATCGAGAACCTGAGGCAGACTGAGCTGAAACTGACCAGGAAGGCCGCC |
| CFTR-C026 | ATGGAGAAGATGATCGAGAACCTGAGGCAGACTGAGCTGAAACTGACCAGGAAGGCCGCC |
| CFTR-C004 | ATGGAAAAGATGATCGAGAACCTGCGGCAGACAGAACTGAAGCTGACCCGGAAGGCCGCG |
| CFTR-C029 | ATGGAAAAGATGATCGAGAACCTGCGGCAGACAGAACTGAAGCTGACCCGGAAGGCCGCG |
| CFTR-C021 | ATGGAGAAGATGATCGAGAACCTGAGGCAGACGGAGCTCAAGCTCACCCGGAAGGCGGCC |
| CFTR-C046 | ATGGAGAAGATGATCGAGAACCTGAGGCAGACGGAGCTCAAGCTCACCCGGAAGGCGGCC |
| CFTR-C008 | ATGGAGAAGATGATCGAGAACCTTAGGCAGACGGAGCTCAAGCTGACCAGGAAGGCGGCC |
| CFTR-C033 | ATGGAGAAGATGATCGAGAACCTTAGGCAGACGGAGCTCAAGCTGACCAGGAAGGCGGCC |
| CFTR-C022 | ATGGAGAAGATGATCGAGAACCTGCGCCAAACCGAACTCAAGCTGACCCGAAAGGCGGCC |
| CFTR-C047 | ATGGAGAAGATGATCGAGAACCTGCGCCAAACCGAACTCAAGCTGACCCGAAAGGCGGCC |
| CFTR-C017 | ATGGAGAAAATGATCGAGAACCTGCGCCAGACCGAGCTGAAGCTGACCAGGAAGGCCGCC |
| CFTR-C042 | ATGGAGAAAATGATCGAGAACCTGCGCCAGACCGAGCTGAAGCTGACCAGGAAGGCCGCC |
| CFTR-C020 | ATGGAGAAAATGATCGAGAACCTCAGGCAGACCGAACTGAAGCTGACACGGAAGGCCGCC |
| CFTR-C045 | ATGGAGAAAATGATCGAGAACCTCAGGCAGACCGAACTGAAGCTGACACGGAAGGCCGCC |
| CFTR-C013 | ATGGAGAAGATGATAGAAAACCTGAGGCAGACCGAGCTCAAGCTGACCAGGAAGGCCGCC |
| CFTR-C038 | ATGGAGAAGATGATAGAAAACCTGAGGCAGACCGAGCTCAAGCTGACCAGGAAGGCCGCC |
| CFTR-C002 | ATGGAGAAGATGATCGAGAACCTGAGGCAGACCGAGCTGAAGCTCACCAGAAAGGCCGCA |
| CFTR-C027 | ATGGAGAAGATGATCGAGAACCTGAGGCAGACCGAGCTGAAGCTCACCAGAAAGGCCGCA |
| CFTR-C011 | ATGGAGAAGATGATCGAAAACCTCAGGCAGACGGAGCTGAAGCTGACCAGGAAGGCCGCC |
| CFTR-C036 | ATGGAGAAGATGATCGAAAACCTCAGGCAGACGGAGCTGAAGCTGACCAGGAAGGCCGCC |
| CFTR-C005 | ATGGAGAAGATGATTGAGAATCTGAGGCAGACCGAACTGAAGCTCACAAGGAAGGCCGCC |
| CFTR-C030 | ATGGAGAAGATGATTGAGAATCTGAGGCAGACCGAACTGAAGCTCACAAGGAAGGCCGCC |
| CFTR-C006 | ATGGAGAAGATGATCGAGAACCTGCGGCAGACAGAACTGAAGCTGACCAGGAAGGCCGCC |
| CFTR-C031 | ATGGAGAAGATGATCGAGAACCTGCGGCAGACAGAACTGAAGCTGACCAGGAAGGCCGCC |
| CFTR-C018 | ATGGAGAAGATGATCGAGAACCTGAGGCAGACCGAGCTGAAGCTGACCCGAAAGGCCGCC |
| CFTR-C043 | ATGGAGAAGATGATCGAGAACCTGAGGCAGACCGAGCTGAAGCTGACCCGAAAGGCCGCC |
| CFTR-C003 | ATGGAGAAAATGATCGAGAACCTGCGGCAGACGGAGCTGAAGCTGACTCGGAAGGCAGCC |
| CFTR-C028 | ATGGAGAAAATGATCGAGAACCTGCGGCAGACGGAGCTGAAGCTGACTCGGAAGGCAGCC |
| CFTR-C016 | ATGGAGAAGATGATAGAGAATCTGCGCCAGACCGAGCTAAAGCTGACCCGGAAGGCCGCC |
| CFTR-C041 | ATGGAGAAGATGATAGAGAATCTGCGCCAGACCGAGCTAAAGCTGACCCGGAAGGCCGCC |
| CFTR-C010 | ATGGAGAAGATGATCGAGAATCTCCGCCAGACCGAGCTGAAGCTGACACGTAAGGCCGCC |
| CFTR-C035 | ATGGAGAAGATGATCGAGAATCTCCGCCAGACCGAGCTGAAGCTGACACGTAAGGCCGCC |
| CFTR-C012 | ATGGAGAAGATGATAGAAAATCTCAGGCAGACCGAGCTGAAGCTGACTAGGAAGGCGGCC |
| CFTR-C037 | ATGGAGAAGATGATAGAAAATCTCAGGCAGACCGAGCTGAAGCTGACTAGGAAGGCGGCC |
| CFTR-C009 | ATGGAGAAGATGATCGAGAACCTGCGACAGACCGAACTCAAGCTCACCCGGAAGGCCGCC |
| CFTR-C034 | ATGGAGAAGATGATCGAGAACCTGCGACAGACCGAACTCAAGCTCACCCGGAAGGCCGCC |
| CFTR-C015 | ATGGAGAAGATGATCGAGAACTTGCGTCAAACCGAGCTGAAGCTGACCCGGAAGGCCGCC |
| CFTR-C040 | ATGGAGAAGATGATCGAGAACTTGCGTCAAACCGAGCTGAAGCTGACCCGGAAGGCCGCC |
| CFTR-C019 | ATGGAAAAGATGATCGAGAACCTGCGGCAAACCGAGCTGAAGCTGACCAGGAAGGCCGCG |
| CFTR-C044 | ATGGAAAAGATGATCGAGAACCTGCGGCAAACCGAGCTGAAGCTGACCAGGAAGGCCGCG |
| CFTR-C007 | ATGGAAAAGATGATCGAGAACCTCAGGCAGACCGAGCTGAAGCTCACCCGGAAGGCCGCA |
| CFTR-C032 | ATGGAAAAGATGATCGAGAACCTCAGGCAGACCGAGCTGAAGCTCACCCGGAAGGCCGCA |
| CFTR-C014 | ATGGAGAAGATGATCGAAAACCTGCGGCAGACCGAGCTGAAACTCACCAGGAAAGCCGCG |
| CFTR-C039 | ATGGAGAAGATGATCGAAAACCTGCGGCAGACCGAGCTGAAACTCACCAGGAAAGCCGCG |
| CFTR-C025 | ATGGAGAAGATGATCGAGAACCTGCGCCAAACCGAACTGAAGCTGACCAGGAAGGCCGCC |
| CFTR-C050 | ATGGAGAAGATGATCGAGAACCTGCGCCAAACCGAACTGAAGCTGACCAGGAAGGCCGCC |
| CFTR-C023 | ATGGAAAAGATGATCGAGAACCTCAGGCAGACCGAACTGAAGCTCACCAGGAAGGCCGCC |
| CFTR-C048 | ATGGAAAAGATGATCGAGAACCTCAGGCAGACCGAACTGAAGCTCACCAGGAAGGCCGCC |
| CFTR-C024 | ATGGAGAAGATGATCGAGAACCTGAGGCAGACTGAGCTCAAGCTGACCAGGAAGGCCGCC |
| CFTR-C049 | ATGGAGAAGATGATCGAGAACCTGAGGCAGACTGAGCTCAAGCTGACCAGGAAGGCCGCC |

FIG. 10 (cont)

```
CFTR-WT    TATGTGAGATACTTCAATAGCTCAGCCTTCTTCTTCTCAGGGTTCTTTGTGGTGTTTTA
CFTR-C001  TATGTGAGGTACTTTAACAGCAGCGCCTTCTTTTTCAGCGGGTTCTTCGTCGTATTCCTC
CFTR-C026  TATGTGAGGTACTTTAACAGCAGCGCCTTCTTTTTCAGCGGGTTCTTCGTCGTATTCCTC
CFTR-C004  TATGTCCGGTACTTCAATAGCAGCGCCTTCTTCTTCTCCGGTTTCTTCGTGGTCTTCCTG
CFTR-C029  TATGTCCGGTACTTCAATAGCAGCGCCTTCTTCTTCTCCGGTTTCTTCGTGGTCTTCCTG
CFTR-C021  TATGTGAGGTACTTCAACAGCTCCGCCTTCTTCTTCAGCGGGTTTTTCGTGGTGTTCCTG
CFTR-C046  TATGTGAGGTACTTCAACAGCTCCGCCTTCTTCTTCAGCGGGTTTTTCGTGGTGTTCCTG
CFTR-C008  TACGTACGGTATTTCAACAGCAGCGCCTTCTTTTTCAGCGGCTTTTTCGTGGTCTTTCTG
CFTR-C033  TACGTACGGTATTTCAACAGCAGCGCCTTCTTTTTCAGCGGCTTTTTCGTGGTCTTTCTG
CFTR-C022  TACGTGCGGTATTTCAATAGCAGCGCCTTCTTCTTCAGCGGCTTCTTCGTCGTCTTCCTC
CFTR-C047  TACGTGCGGTATTTCAATAGCAGCGCCTTCTTCTTCAGCGGCTTCTTCGTCGTCTTCCTC
CFTR-C017  TACGTGAGATACTTCAACTCATCCGCCTTCTTCTTTTCCGGCTTCTTCGTGGTCTTCCTG
CFTR-C042  TACGTGAGATACTTCAACTCATCCGCCTTCTTCTTTTCCGGCTTCTTCGTGGTCTTCCTG
CFTR-C020  TACGTGAGGTACTTCAACAGCAGCGCGTTTTCTTCTCGGGCTTCTTTGTGGTGTTCCTG
CFTR-C045  TACGTGAGGTACTTCAACAGCAGCGCGTTTTCTTCTCGGGCTTCTTTGTGGTGTTCCTG
CFTR-C013  TACGTGCGGTACTTTAACAGCAGCGCCTTCTTCTTTAGCGGCTTTTTCGTGGTGTTCCTG
CFTR-C038  TACGTGCGGTACTTTAACAGCAGCGCCTTCTTCTTTAGCGGCTTTTTCGTGGTGTTCCTG
CFTR-C002  TACGTCAGGTACTTCAACAGCTCCGCCTTCTTCTTCAGCGGCTTCTTCGTGGTGTTCCTG
CFTR-C027  TACGTCAGGTACTTCAACAGCTCCGCCTTCTTCTTCAGCGGCTTCTTCGTGGTGTTCCTG
CFTR-C011  TACGTGAGGTACTTCAACTCATCCGCCTTCTTTTTCTCCGGATTCTTCGTGGTGTTCCTG
CFTR-C036  TACGTGAGGTACTTCAACTCATCCGCCTTCTTTTTCTCCGGATTCTTCGTGGTGTTCCTG
CFTR-C005  TACGTGAGGTACTTCAATAGCAGCGCCTTTTTTTTTAGCGGGTTCTTCGTGGTCTTCCTG
CFTR-C030  TACGTGAGGTACTTCAATAGCAGCGCCTTTTTTTTTAGCGGGTTCTTCGTGGTCTTCCTG
CFTR-C006  TACGTGCGCTACTTCAATTCCTCCGCCTTCTTCTTCAGCGGCTTCTTCGTCGTGTTCCTG
CFTR-C031  TACGTGCGCTACTTCAATTCCTCCGCCTTCTTCTTCAGCGGCTTCTTCGTCGTGTTCCTG
CFTR-C018  TACGTGAGGTATTTCAATTCCAGCGCCTTCTTCTTCAGCGGCTTCTTCGTGGTGTTCCTG
CFTR-C043  TACGTGAGGTATTTCAATTCCAGCGCCTTCTTCTTCAGCGGCTTCTTCGTGGTGTTCCTG
CFTR-C003  TATGTGCGGTATTTTAACAGCAGCGCGTTCTTCTTCAGCGGCTTCTTCGTCGTGTTCCTC
CFTR-C028  TATGTGCGGTATTTTAACAGCAGCGCGTTCTTCTTCAGCGGCTTCTTCGTCGTGTTCCTC
CFTR-C016  TATGTCAGGTATTTCAATTCCAGCGCCTTTTTCTTCAGCGGCTTCTTTGTTGTGTTCCTG
CFTR-C041  TATGTCAGGTATTTCAATTCCAGCGCCTTTTTCTTCAGCGGCTTCTTTGTTGTGTTCCTG
CFTR-C010  TATGTCAGGTACTTCAACAGCAGCGCCTTCTTCTTCTCCGGCTTTTTCGTGGTGTTCCTG
CFTR-C035  TATGTCAGGTACTTCAACAGCAGCGCCTTCTTCTTCTCCGGCTTTTTCGTGGTGTTCCTG
CFTR-C012  TACGTGAGGTACTTTAACAGCTCCGCCTTCTTCTTCAGCGGCTTTTTGTGGTGTTCCTC
CFTR-C037  TACGTGAGGTACTTTAACAGCTCCGCCTTCTTCTTCAGCGGCTTTTTGTGGTGTTCCTC
CFTR-C009  TACGTGAGGTACTTCAACTCCTCCGCCTTCTTCTTTAGCGGCTTCTTCGTGGTCTTTCTG
CFTR-C034  TACGTGAGGTACTTCAACTCCTCCGCCTTCTTCTTTAGCGGCTTCTTCGTGGTCTTTCTG
CFTR-C015  TACGTGCGATACTTCAACTCGTCCGCGTTCTTCTTCAGCGGCTTTTTCGTGGTGTTCCTG
CFTR-C040  TACGTGCGATACTTCAACTCGTCCGCGTTCTTCTTCAGCGGCTTTTTCGTGGTGTTCCTG
CFTR-C019  TACGTCCGGTACTTCAACAGCAGCGCCTTCTTCTTCTCCGGCTTCTTCGTGGTGTTCCTG
CFTR-C044  TACGTCCGGTACTTCAACAGCAGCGCCTTCTTCTTCTCCGGCTTCTTCGTGGTGTTCCTG
CFTR-C007  TATGTGAGGTACTTCAACAGCTCCGCATTTTTCTTCAGCGGGTTCTTCGTGGTGTTCCTG
CFTR-C032  TATGTGAGGTACTTCAACAGCTCCGCATTTTTCTTCAGCGGGTTCTTCGTGGTGTTCCTG
CFTR-C014  TACGTGAGGTACTTTAACTCCTCCGCCTTTTTTTTCAGCGGCTTTTTGTGGTGTTTCTG
CFTR-C039  TACGTGAGGTACTTTAACTCCTCCGCCTTTTTTTTCAGCGGCTTTTTGTGGTGTTTCTG
CFTR-C025  TACGTCCGGTATTTCAACTCCTCCGCATTCTTTTTCTCCGGCTTCTTCGTGGTGTTCCTG
CFTR-C050  TACGTCCGGTATTTCAACTCCTCCGCATTCTTTTTCTCCGGCTTCTTCGTGGTGTTCCTG
CFTR-C023  TACGTGCGGTATTTCAATTCGTCAGCCTTCTTCTTTAGCGGCTTTTTGTGGTGTTCCTC
CFTR-C048  TACGTGCGGTATTTCAATTCGTCAGCCTTCTTCTTTAGCGGCTTTTTGTGGTGTTCCTC
CFTR-C024  TACGTGAGGTACTTCAACTCATCGGCCTTCTTCTTCAGCGGCTTCTTCGTGGTGTTTCTC
CFTR-C049  TACGTGAGGTACTTCAACTCATCGGCCTTCTTCTTCAGCGGCTTCTTCGTGGTGTTTCTC
           **,**   * **,**,**,      ** **,**,**,   ** **,**,** ** **,,*
```

FIG. 10 (cont)

```
CFTR-WT    TCTGTGCTTCCCTATGCACTAATCAAAGGAATCATCCTCCGGAAAATATTCACCACCATC
CFTR-C001  AGCGTACTGCCCTACGCCCTCATCAAGGGGATCATCCTCCGGAAGATCTTCACAACCATC
CFTR-C026  AGCGTACTGCCCTACGCCCTCATCAAGGGGATCATCCTCCGGAAGATCTTCACAACCATC
CFTR-C004  TCCGTGCTCCCGTACGCCCTGATCAAGGGCATCATCCTGAGGAAAATCTTCACCACCATC
CFTR-C029  TCCGTGCTCCCGTACGCCCTGATCAAGGGCATCATCCTGAGGAAAATCTTCACCACCATC
CFTR-C021  AGCGTGCTGCCCTACGCCCTGATCAAGGGCATCATCCTGCGGAAGATCTTCACCACCATT
CFTR-C046  AGCGTGCTGCCCTACGCCCTGATCAAGGGCATCATCCTGCGGAAGATCTTCACCACCATT
CFTR-C008  AGCGTGCTGCCCTACGCACTGATCAAGGGGATCATCCTCAGGAAGATCTTTACCACCATA
CFTR-C033  AGCGTGCTGCCCTACGCACTGATCAAGGGGATCATCCTCAGGAAGATCTTTACCACCATA
CFTR-C022  TCCGTCCTGCCCTACGCCCTGATCAAGGGGATCATCCTGAGGAAGATCTTTACCACCATC
CFTR-C047  TCCGTCCTGCCCTACGCCCTGATCAAGGGGATCATCCTGAGGAAGATCTTTACCACCATC
CFTR-C017  AGCGTGCTGCCCTACGCCCTGATCAAGGGCATAATCCTCAGGAAAATCTTCACCACCATC
CFTR-C042  AGCGTGCTGCCCTACGCCCTGATCAAGGGCATAATCCTCAGGAAAATCTTCACCACCATC
CFTR-C020  TCCGTGCTGCCGTACGCCCTCATCAAGGGCATCATACTGCGGAAGATCTTTACCACCATC
CFTR-C045  TCCGTGCTGCCGTACGCCCTCATCAAGGGCATCATACTGCGGAAGATCTTTACCACCATC
CFTR-C013  AGCGTGCTGCCCTACGCCCTGATCAAGGGCATCATCCTCAGGAAAATCTTCACCACCATC
CFTR-C038  AGCGTGCTGCCCTACGCCCTGATCAAGGGCATCATCCTCAGGAAAATCTTCACCACCATC
CFTR-C002  TCCGTGCTGCCCTATGCGCTGATCAAGGGAATCATCCTGCGGAAAATCTTTACCACCATC
CFTR-C027  TCCGTGCTGCCCTATGCGCTGATCAAGGGAATCATCCTGCGGAAAATCTTTACCACCATC
CFTR-C011  TCCGTGCTGCCCTATGCCCTGATCAAGGGCATCATCCTCCGGAAGATCTTCACAACCATC
CFTR-C036  TCCGTGCTGCCCTATGCCCTGATCAAGGGCATCATCCTCCGGAAGATCTTCACAACCATC
CFTR-C005  AGCGTGCTGCCCTATGCCCTCATCAAAGGAATCATCCTGCGCAAGATCTTCACCACCATC
CFTR-C030  AGCGTGCTGCCCTATGCCCTCATCAAAGGAATCATCCTGCGCAAGATCTTCACCACCATC
CFTR-C006  AGCGTGCTGCCCTACGCCCTGATCAAGGGGATCATACTCCGGAAAATCTTCACCACCATC
CFTR-C031  AGCGTGCTGCCCTACGCCCTGATCAAGGGGATCATACTCCGGAAAATCTTCACCACCATC
CFTR-C018  AGCGTGCTTCCCTACGCCCTGATCAAGGGAATCATCCTCAGGAAGATCTTCACCACGATC
CFTR-C043  AGCGTGCTTCCCTACGCCCTGATCAAGGGAATCATCCTCAGGAAGATCTTCACCACGATC
CFTR-C003  AGCGTGCTGCCCTACGCCCTGATCAAGGGTATCATACTGAGGAAAATCTTCACCACCATC
CFTR-C028  AGCGTGCTGCCCTACGCCCTGATCAAGGGTATCATACTGAGGAAAATCTTCACCACCATC
CFTR-C016  AGCGTGCTGCCCTACGCCCTGATCAAAGGAATCATTCTCCGGAAAATCTTCACCACCATC
CFTR-C041  AGCGTGCTGCCCTACGCCCTGATCAAAGGAATCATTCTCCGGAAAATCTTCACCACCATC
CFTR-C010  AGCGTGCTGCCGTATGCCCTGATCAAGGGCATCATCCTGAGGAAAATCTTCACGACGATC
CFTR-C035  AGCGTGCTGCCGTATGCCCTGATCAAGGGCATCATCCTGAGGAAAATCTTCACGACGATC
CFTR-C012  TCGGTGCTGCCCTACGCCCTGATCAAGGGCATCATTCTGCGCAAGATCTTCACCACCATC
CFTR-C037  TCGGTGCTGCCCTACGCCCTGATCAAGGGCATCATTCTGCGCAAGATCTTCACCACCATC
CFTR-C009  AGCGTGCTGCCCTACGCCCTCATCAAGGGCATCATCCTGAGGAAGATCTTTACCACCATC
CFTR-C034  AGCGTGCTGCCCTACGCCCTCATCAAGGGCATCATCCTGAGGAAGATCTTTACCACCATC
CFTR-C015  AGCGTGCTGCCCTATGCCCTGATCAAGGGCATCATCCTGAGGAAAATCTTCACCACCATC
CFTR-C040  AGCGTGCTGCCCTATGCCCTGATCAAGGGCATCATCCTGAGGAAAATCTTCACCACCATC
CFTR-C019  AGCGTGCTGCCTTACGCCCTGATCAAGGGGATCATCCTCAGGAAGATCTTCACGACCATC
CFTR-C044  AGCGTGCTGCCTTACGCCCTGATCAAGGGGATCATCCTCAGGAAGATCTTCACGACCATC
CFTR-C007  AGCGTGCTGCCCTACGCCCTGATCAAGGGCATCATCCTCAGGAAGATCTTCACCACCATC
CFTR-C032  AGCGTGCTGCCCTACGCCCTGATCAAGGGCATCATCCTCAGGAAGATCTTCACCACCATC
CFTR-C014  AGCGTACTGCCCTATGCCCTCATCAAGGCATTATCCTGCGCAAGATCTTTACAACCATC
CFTR-C039  AGCGTACTGCCCTATGCCCTCATCAAGGCATTATCCTGCGCAAGATCTTTACAACCATC
CFTR-C025  AGCGTGCTGCCCTATGCCCTGATCAAGGGGATCATCCTGAGGAAGATCTTCACCACGATC
CFTR-C050  AGCGTGCTGCCCTATGCCCTGATCAAGGGGATCATCCTGAGGAAGATCTTCACCACGATC
CFTR-C023  TCTGTGCTGCCCTATGCACTGATCAAGGGAATCATCCTGAGGAAAATCTTCACCACCATC
CFTR-C048  TCTGTGCTGCCCTATGCACTGATCAAGGGAATCATCCTGAGGAAAATCTTCACCACCATC
CFTR-C024  AGCGTCCTGCCGTACGCTCTGATCAAGGGCATTATCCTGCGGAAGATCTTCACCACCATC
CFTR-C049  AGCGTCCTGCCGTACGCTCTGATCAAGGGCATTATCCTGCGGAAGATCTTCACCACCATC
           ** ** ** ** ** ** ***** ** ** **  *  ** **  ** ** ** **
```

FIG. 10 (cont)

```
CFTR-WT   TCATTCTGCATTGTTCTGCGCATGGCGGTCACTCGGCAATTTCCCTGGGCTGTACAAACA
CFTR-C001 TCCTTCTGCATTGTGCTGCGGATGGCCGTGACCCGGCAGTTCCCGTGGGCCGTGCAGACG
CFTR-C026 TCCTTCTGCATTGTGCTGCGGATGGCCGTGACCCGGCAGTTCCCGTGGGCCGTGCAGACG
CFTR-C004 AGCTTCTGTATCGTGCTGAGGATGGCCGTCACCAGGCAGTTTCCCTGGGCCGTGCAGACC
CFTR-C029 AGCTTCTGTATCGTGCTGAGGATGGCCGTCACCAGGCAGTTTCCCTGGGCCGTGCAGACC
CFTR-C021 AGCTTCTGCATCGTGCTGCGGATGGCCGTGACCCGGCAGTTCCCCTGGGCCGTGCAGACC
CFTR-C046 AGCTTCTGCATCGTGCTGCGGATGGCCGTGACCCGGCAGTTCCCCTGGGCCGTGCAGACC
CFTR-C008 TCCTTCTGCATCGTGCTGAGGATGGCCGTGACCCGGCAGTTCCCCTGGGCCGTCCAGACC
CFTR-C033 TCCTTCTGCATCGTGCTGAGGATGGCCGTGACCCGGCAGTTCCCCTGGGCCGTCCAGACC
CFTR-C022 TCGTTTTGCATCGTGCTGCGAATGGCCGTGACCAGGCAATTCCCCTGGGCCGTGCAGACC
CFTR-C047 TCGTTTTGCATCGTGCTGCGAATGGCCGTGACCAGGCAATTCCCCTGGGCCGTGCAGACC
CFTR-C017 TCTTTCTGCATCGTGCTGAGGATGGCCGTGACCAGGCAATTCCCCTGGGCCGTCCAGACC
CFTR-C042 TCTTTCTGCATCGTGCTGAGGATGGCCGTGACCAGGCAATTCCCCTGGGCCGTCCAGACC
CFTR-C020 AGCTTCTGTATCGTGCTGAGGATGGCCGTGACCAGGCAGTTCCCTGGGCCGTCCAGACC
CFTR-C045 AGCTTCTGTATCGTGCTGAGGATGGCCGTGACCAGGCAGTTCCCTGGGCCGTCCAGACC
CFTR-C013 AGCTTTTGCATCGTGCTCCGAATGGCCGTGACCCGGCAGTTCCCTGGGCCGTCCAAACC
CFTR-C038 AGCTTTTGCATCGTGCTCCGAATGGCCGTGACCCGGCAGTTCCCCTGGGCCGTCCAAACC
CFTR-C002 TCCTTCTGCATCGTGCTGAGGATGGCCGTGACCCGCCAGTTCCCCTGGGCGGTGCAAACC
CFTR-C027 TCCTTCTGCATCGTGCTGAGGATGGCCGTGACCCGCCAGTTCCCCTGGGCGGTGCAAACC
CFTR-C011 TCCTTCTGCATTGTACTGAGGATGGCCGTGACTAGGCAGTTCCCCTGGGCCGTCCAGACC
CFTR-C036 TCCTTCTGCATTGTACTGAGGATGGCCGTGACTAGGCAGTTCCCCTGGGCCGTCCAGACC
CFTR-C005 AGCTTCTGCATCGTCCTGAGGATGGCCGTGACGAGGCAGTTTCCCTGGGCCGTGCAGACC
CFTR-C030 AGCTTCTGCATCGTCCTGAGGATGGCCGTGACGAGGCAGTTTCCCTGGGCCGTGCAGACC
CFTR-C006 TCCTTCTGCATAGTTCTGCGCATGGCCGTCACCAGGCAGTTTCCCTGGGCCGTGCAGACG
CFTR-C031 TCCTTCTGCATAGTTCTGCGCATGGCCGTCACCAGGCAGTTTCCCTGGGCCGTGCAGACG
CFTR-C018 AGCTTCTGCATCGTGCTGAGGATGGCCGTGACCAGGCAGTTTCCCTGGGCCGTTCAGACC
CFTR-C043 AGCTTCTGCATCGTGCTGAGGATGGCCGTGACCAGGCAGTTTCCCTGGGCCGTTCAGACC
CFTR-C003 TCATTCTGCATCGTGCTGCGGATGGCCGTGACCCGGCAGTTTCCGTGGGCGGTGCAGACC
CFTR-C028 TCATTCTGCATCGTGCTGCGGATGGCCGTGACCCGGCAGTTTCCGTGGGCGGTGCAGACC
CFTR-C016 TCCTTTTGTATCGTGCTTAGGATGGCCGTGACCCGACAGTTTCCCTGGGCCGTGCAGACC
CFTR-C041 TCCTTTTGTATCGTGCTTAGGATGGCCGTGACCCGACAGTTTCCCTGGGCCGTGCAGACC
CFTR-C010 AGCTTTTGCATTGTGCTGCGGATGGCCGTCACCAGGCAGTTCCCCTGGGCCGTGCAGACC
CFTR-C035 AGCTTTTGCATTGTGCTGCGGATGGCCGTCACCAGGCAGTTCCCCTGGGCCGTGCAGACC
CFTR-C012 TCATTCTGCATAGTGCTGAGGATGGCCGTGACCCGACAGTTCCCTTGGGCTGTGCAGACC
CFTR-C037 TCATTCTGCATAGTGCTGAGGATGGCCGTGACCCGACAGTTCCCTTGGGCTGTGCAGACC
CFTR-C009 TCCTTCTGTATCGTCCTCCGAATGGCCGTGACGCGTCAGTTCCCCTGGGCTGTCCAGACT
CFTR-C034 TCCTTCTGTATCGTCCTCCGAATGGCCGTGACGCGTCAGTTCCCCTGGGCTGTCCAGACT
CFTR-C015 TCCTTCTGTATCGTGCTGCGAATGGCCGTGACCAGGCAGTTCCCCTGGGCCGTGCAAACC
CFTR-C040 TCCTTCTGTATCGTGCTGCGAATGGCCGTGACCAGGCAGTTCCCCTGGGCCGTGCAAACC
CFTR-C019 TCCTTTTGCATAGTCCTGCGCATGGCCGTGACCCGCCAGTTCCCCTGGGCCGTGCAGACG
CFTR-C044 TCCTTTTGCATAGTCCTGCGCATGGCCGTGACCCGCCAGTTCCCCTGGGCCGTGCAGACG
CFTR-C007 AGCTTCTGTATCGTGCTGCGGATGGCCGTGACCAGGCAGTTCCCCTGGGCCGTGCAGACC
CFTR-C032 AGCTTCTGTATCGTGCTGCGGATGGCCGTGACCAGGCAGTTCCCCTGGGCCGTGCAGACC
CFTR-C014 TCGTTCTGCATCGTGCTGCGAATGGCCGTGACCCGCCAGTTCCCGTGGGCCGTCCAGACC
CFTR-C039 TCGTTCTGCATCGTGCTGCGAATGGCCGTGACCCGCCAGTTCCCGTGGGCCGTCCAGACC
CFTR-C025 AGCTTCTGCATCGTGCTCAGGATGGCGGTCACCAGGCAGTTCCCCTGGGCCGTTCAGACA
CFTR-C050 AGCTTCTGCATCGTGCTCAGGATGGCGGTCACCAGGCAGTTCCCCTGGGCCGTTCAGACA
CFTR-C023 AGCTTCTGTATCGTGCTCCGCATGGCCGTGACCAGGCAGTTCCCCTGGGCCGTGCAGACC
CFTR-C048 AGCTTCTGTATCGTGCTCCGCATGGCCGTGACCAGGCAGTTCCCCTGGGCCGTGCAGACC
CFTR-C024 AGCTTCTGCATCGTGCTCCGGATGGCCGTGACGAGGCAGTTCCCCTGGGCCGTGCAGACC
CFTR-C049 AGCTTCTGCATCGTGCTCCGGATGGCCGTGACGAGGCAGTTCCCCTGGGCCGTGCAGACC
          **,**,** ** **    *  ***** ** **   *  **,**,** *****  ** **,**
```

FIG. 10 (cont)

```
CFTR-WT   TGGTATGACTCTCTTGGAGCAATAAACAAAATACAGGATTTCTTACAAAAGCAAGAATAT
CFTR-C001 TGGTACGACTCACTGGGCGCCATCAACAAGATCCAGGATTTTCTACAGAAGCAGGAGTAC
CFTR-C026 TGGTACGACTCACTGGGCGCCATCAACAAGATCCAGGATTTTCTACAGAAGCAGGAGTAC
CFTR-C004 TGGTACGATAGCCTGGGCGCCATCAACAAGATCCAAGACTTCCTGCAGAAGCAGGAATAC
CFTR-C029 TGGTACGATAGCCTGGGCGCCATCAACAAGATCCAAGACTTCCTGCAGAAGCAGGAATAC
CFTR-C021 TGGTACGATAGCCTGGGCGCCATCAACAAAATCCAGGACTTCCTGCAGAAGCAGGAGTAC
CFTR-C046 TGGTACGATAGCCTGGGCGCCATCAACAAAATCCAGGACTTCCTGCAGAAGCAGGAGTAC
CFTR-C008 TGGTACGATAGCCTGGGAGCCATCAACAAGATCCAGGACTTCCTGCAGAAGCAGGAGTAC
CFTR-C033 TGGTACGATAGCCTGGGAGCCATCAACAAGATCCAGGACTTCCTGCAGAAGCAGGAGTAC
CFTR-C022 TGGTACGACTCCCTGGGAGCCATCAACAAAATCCAAGACTTTCTGCAGAAGCAGGAGTAC
CFTR-C047 TGGTACGACTCCCTGGGAGCCATCAACAAAATCCAAGACTTTCTGCAGAAGCAGGAGTAC
CFTR-C017 TGGTACGATAGCCTGGGCGCCATCAATAAGATCCAAGACTTCCTGCAGAAGCAGGAATAC
CFTR-C042 TGGTACGATAGCCTGGGCGCCATCAATAAGATCCAAGACTTCCTGCAGAAGCAGGAATAC
CFTR-C020 TGGTACGACAGCCTGGGTGCCATTAATAAGATCCAAGACTTCCTGCAGAAGCAGGAGTAC
CFTR-C045 TGGTACGACAGCCTGGGTGCCATTAATAAGATCCAAGACTTCCTGCAGAAGCAGGAGTAC
CFTR-C013 TGGTACGACAGCCTGGGCGCCATAAATAAGATACAGGACTTCCTGCAGAAGCAGGAGTAC
CFTR-C038 TGGTACGACAGCCTGGGCGCCATAAATAAGATACAGGACTTCCTGCAGAAGCAGGAGTAC
CFTR-C002 TGGTACGACAGCCTGGGGGCCATCAACAAGATCCAGGACTTCCTGCAAAAGCAAGAGTAC
CFTR-C027 TGGTACGACAGCCTGGGGGCCATCAACAAGATCCAGGACTTCCTGCAAAAGCAAGAGTAC
CFTR-C011 TGGTACGACAGCCTGGGCGCAATCAACAAGATCCAGGACTTTCTGCAGAAGCAAGAGTAT
CFTR-C036 TGGTACGACAGCCTGGGCGCAATCAACAAGATCCAGGACTTTCTGCAGAAGCAAGAGTAT
CFTR-C005 TGGTACGACAGCCTGGGGGCCATCAATAAGATCCAGGACTTCCTGCAGAAGCAGGAGTAC
CFTR-C030 TGGTACGACAGCCTGGGGGCCATCAATAAGATCCAGGACTTCCTGCAGAAGCAGGAGTAC
CFTR-C006 TGGTACGACTCCCTGGGCGCCATCAACAAGATCCAAGACTTCCTCCAGAAGCAGGAGTAC
CFTR-C031 TGGTACGACTCCCTGGGCGCCATCAACAAGATCCAAGACTTCCTCCAGAAGCAGGAGTAC
CFTR-C018 TGGTACGATAGCCTGGGAGCCATCAATAAGATCCAGGACTTCCTGCAGAAGCAGGAGTAC
CFTR-C043 TGGTACGATAGCCTGGGAGCCATCAATAAGATCCAGGACTTCCTGCAGAAGCAGGAGTAC
CFTR-C003 TGGTACGACAGCCTGGGCGCCATCAACAAGATCCAGGACTTTCTCCAGAAGCAGGAATAC
CFTR-C028 TGGTACGACAGCCTGGGCGCCATCAACAAGATCCAGGACTTTCTCCAGAAGCAGGAATAC
CFTR-C016 TGGTACGATAGCCTGGGCGCCATCAATAAAATCCAGGACTTCCTGCAAAAGCAGGAATAC
CFTR-C041 TGGTACGATAGCCTGGGCGCCATCAATAAAATCCAGGACTTCCTGCAAAAGCAGGAATAC
CFTR-C010 TGGTACGACTCCCTGGGGGCCATCAACAAGATCCAAGATTTCCTCCAGAAGCAGGAGTAC
CFTR-C035 TGGTACGACTCCCTGGGGGCCATCAACAAGATCCAAGATTTCCTCCAGAAGCAGGAGTAC
CFTR-C012 TGGTATGACAGCCTCGGGGCCATCAACAAGATCCAGGACTTTCTGCAGAAGCAGGAGTAT
CFTR-C037 TGGTATGACAGCCTCGGGGCCATCAACAAGATCCAGGACTTTCTGCAGAAGCAGGAGTAT
CFTR-C009 TGGTATGACAGCCTAGGGGCCATCAACAAGATCCAGGATTTCCTGCAAAAACAGGAGTAC
CFTR-C034 TGGTATGACAGCCTAGGGGCCATCAACAAGATCCAGGATTTCCTGCAAAAACAGGAGTAC
CFTR-C015 TGGTACGACAGCCTGGGGGCCATCAACAAGATCCAGGACTTTCTGCAGAAGCAGGAATAT
CFTR-C040 TGGTACGACAGCCTGGGGGCCATCAACAAGATCCAGGACTTTCTGCAGAAGCAGGAATAT
CFTR-C019 TGGTACGACAGCCTGGGGGCCATCAACAAGATCCAGGACTTCCTGCAAAAGCAAGAGTAC
CFTR-C044 TGGTACGACAGCCTGGGGGCCATCAACAAGATCCAGGACTTCCTGCAAAAGCAAGAGTAC
CFTR-C007 TGGTACGACTCGCTGGGCGCCATCAACAAGATCCAGGATTTCCTCCAGAAACAGGAGTAC
CFTR-C032 TGGTACGACTCGCTGGGCGCCATCAACAAGATCCAGGATTTCCTCCAGAAACAGGAGTAC
CFTR-C014 TGGTACGACTCCCTCGGCGCGATCAACAAAATACAGGACTTCCTGCAGAAACAGGAGTAC
CFTR-C039 TGGTACGACTCCCTCGGCGCGATCAACAAAATACAGGACTTCCTGCAGAAACAGGAGTAC
CFTR-C025 TGGTACGACAGCCTGGGGGCCATCAACAAGATCCAGGATTTCCTGCAGAAACAGGAATAT
CFTR-C050 TGGTACGACAGCCTGGGGGCCATCAACAAGATCCAGGATTTCCTGCAGAAACAGGAATAT
CFTR-C023 TGGTACGACTCCCTGGGGGCCATCAATAAGATCCAGGATTTCCTGCAGAAACAGGAGTAC
CFTR-C048 TGGTACGACTCCCTGGGGGCCATCAATAAGATCCAGGATTTCCTGCAGAAACAGGAGTAC
CFTR-C024 TGGTACGACAGCCTGGGCGCCATCAATAAAATCCAGGACTTTCTCCAGAAGCAGGAGTAC
CFTR-C049 TGGTACGACAGCCTGGGCGCCATCAATAAAATCCAGGACTTTCTCCAGAAGCAGGAGTAC
          *****.**.   ** ** ** ** **.**.** **.**.**.**..* **.**.**.**.**.
```

FIG. 10 (cont)

```
CFTR-WT   AAGACATTGGAATATAACTTAACGACTACAGAAGTAGTGATGGAGAATGTAACAGCCTTC
CFTR-C001 AAAACCCTGGAGTACAACCTCACGACGACCGAGGTGGTGATGGAGAACGTGACCGCCTTC
CFTR-C026 AAAACCCTGGAGTACAACCTCACGACGACCGAGGTGGTGATGGAGAACGTGACCGCCTTC
CFTR-C004 AAGACCCTCGAGTACAACCTGACCACCACCGAGGTGGTGATGGAGAACGTGACCGCCTTC
CFTR-C029 AAGACCCTCGAGTACAACCTGACCACCACCGAGGTGGTGATGGAGAACGTGACCGCCTTC
CFTR-C021 AAGACCCTCGAGTACAACCTGACCACCACCGAGGTCGTGATGGAGAACGTGACCGCCTTT
CFTR-C046 AAGACCCTCGAGTACAACCTGACCACCACCGAGGTCGTGATGGAGAACGTGACCGCCTTT
CFTR-C008 AAGACCCTCGAGTACAACCTGACTACCACAGAAGTGGTGATGGAAAACGTCACCGCCTTT
CFTR-C033 AAGACCCTCGAGTACAACCTGACTACCACAGAAGTGGTGATGGAAAACGTCACCGCCTTT
CFTR-C022 AAAACCCTGGAGTACAACCTGACCACCACGGAGGTCGTGATGGAGAACGTCACCGCCTTC
CFTR-C047 AAAACCCTGGAGTACAACCTGACCACCACGGAGGTCGTGATGGAGAACGTCACCGCCTTC
CFTR-C017 AAGACCCTGGAGTACAACCTCACCACCACCGAGGTGGTGATGGAGAACGTCACCGCCTTC
CFTR-C042 AAGACCCTGGAGTACAACCTCACCACCACCGAGGTGGTGATGGAGAACGTCACCGCCTTC
CFTR-C020 AAGACCTTGGAGTACAACCTCACCACTACCGAGGTGGTCATGGAGAACGTGACCGCCTTC
CFTR-C045 AAGACCTTGGAGTACAACCTCACCACTACCGAGGTGGTCATGGAGAACGTGACCGCCTTC
CFTR-C013 AAGACCCTGGAGTACAACCTGACCACCACCGAGGTGGTGATGGAGAACGTGACCGCCTTC
CFTR-C038 AAGACCCTGGAGTACAACCTGACCACCACCGAGGTGGTGATGGAGAACGTGACCGCCTTC
CFTR-C002 AAGACCCTGGAATACAACCTGACCACCACCGAAGTCGTCATGGAGAATGTGACCGCCTTC
CFTR-C027 AAGACCCTGGAATACAACCTGACCACCACCGAAGTCGTCATGGAGAATGTGACCGCCTTC
CFTR-C011 AAGACCCTGGAGTACAACCTGACGACTACGGAGGTGGTCATGGAAAACGTGACCGCATTC
CFTR-C036 AAGACCCTGGAGTACAACCTGACGACTACGGAGGTGGTCATGGAAAACGTGACCGCATTC
CFTR-C005 AAGACCCTGGAGTACAACCTGACAACCACCGAGGTGGTCATGGAGAACGTGACGGCATTC
CFTR-C030 AAGACCCTGGAGTACAACCTGACAACCACCGAGGTGGTCATGGAGAACGTGACGGCATTC
CFTR-C006 AAGACCCTGGAGTACAACCTGACCACCACGGAGGTGGTGATGGAGAACGTGACCGCCTTC
CFTR-C031 AAGACCCTGGAGTACAACCTGACCACCACGGAGGTGGTGATGGAGAACGTGACCGCCTTC
CFTR-C018 AAGACCCTGGAGTATAACCTGACCACCACCGAGGTCGTGATGGAAAACGTGACCGCCTTC
CFTR-C043 AAGACCCTGGAGTATAACCTGACCACCACCGAGGTCGTGATGGAAAACGTGACCGCCTTC
CFTR-C003 AAGACCCTCGAATATAACCTGACCACCACCGAGGTGGTGATGGAGAACGTCACCGCCTTC
CFTR-C028 AAGACCCTCGAATATAACCTGACCACCACCGAGGTGGTGATGGAGAACGTCACCGCCTTC
CFTR-C016 AAGACGCTAGAGTACAACCTGACCACCACCGAGGTGGTAATGGAGAACGTAACCGCCTTC
CFTR-C041 AAGACGCTAGAGTACAACCTGACCACCACCGAGGTGGTAATGGAGAACGTAACCGCCTTC
CFTR-C010 AAGACGCTGGAGTATAATCTGACCACCACCGAAGTGGTGATGGAGAACGTGACAGCCTTC
CFTR-C035 AAGACGCTGGAGTATAATCTGACCACCACCGAAGTGGTGATGGAGAACGTGACAGCCTTC
CFTR-C012 AAGACCCTCGAGTACAACCTGACCACCACCGAGGTGGTCATGGAGAACGTCACCGCCTTC
CFTR-C037 AAGACCCTCGAGTACAACCTGACCACCACCGAGGTGGTCATGGAGAACGTCACCGCCTTC
CFTR-C009 AAGACCCTAGAGTACAATCTCACCACCACGGAGGTCGTGATGGAGAACGTGACGGCCTTC
CFTR-C034 AAGACCCTAGAGTACAATCTCACCACCACGGAGGTCGTGATGGAGAACGTGACGGCCTTC
CFTR-C015 AAGACCCTGGAGTACAACCTGACCACTACCGAGGTGGTGATGGAAAACGTGACCGCCTTC
CFTR-C040 AAGACCCTGGAGTACAACCTGACCACTACCGAGGTGGTGATGGAAAACGTGACCGCCTTC
CFTR-C019 AAAACCCTGGAATATAACCTGACCACCACCGAAGTCGTCATGGAGAACGTGACAGCCTTC
CFTR-C044 AAAACCCTGGAATATAACCTGACCACCACCGAAGTCGTCATGGAGAACGTGACAGCCTTC
CFTR-C007 AAAACCCTTGAGTATAACCTGACCACCACCGAGGTGGTGATGGAGAATGTCACGGCCTTC
CFTR-C032 AAAACCCTTGAGTATAACCTGACCACCACCGAGGTGGTGATGGAGAATGTCACGGCCTTC
CFTR-C014 AAAACCCTGGAGTACAACCTCACCACCACGGAGGTGGTGATGGAAAACGTGACCGCCTTC
CFTR-C039 AAAACCCTGGAGTACAACCTCACCACCACGGAGGTGGTGATGGAAAACGTGACCGCCTTC
CFTR-C025 AAGACCCTGGAGTACAACCTGACCACCACAGAGGTCGTGATGGAGAACGTGACCGCCTTT
CFTR-C050 AAGACCCTGGAGTACAACCTGACCACCACAGAGGTCGTGATGGAGAACGTGACCGCCTTT
CFTR-C023 AAAACCCTGGAGTATAATCTGACCACCACTGAGGTGGTAATGGAGAACGTCACCGCCTTC
CFTR-C048 AAAACCCTGGAGTATAATCTGACCACCACTGAGGTGGTAATGGAGAACGTCACCGCCTTC
CFTR-C024 AAAACCCTCGAGTACAACCTGACCACCACCGAGGTCGTGATGGAGAACGTGACCGCCTTC
CFTR-C049 AAAACCCTCGAGTACAACCTGACCACCACCGAGGTCGTGATGGAGAACGTGACCGCCTTC
          **.** .* **.**.**.. * ** ** ** ** ** ** ***** ** ** ** ** **.
```

FIG. 10 (cont)

```
CFTR-WT     TGGGAGGAGGGATTTGGGGAATTATTTGAGAAAGCAAAACAAAACAATAACAATAGAAAA
CFTR-C001   TGGGAGGAGGGCTTCGGAGAGCTGTTCGAGAAGGCCAAGCAAAATAACAACAACAGGAAA
CFTR-C026   TGGGAGGAGGGCTTCGGAGAGCTGTTCGAGAAGGCCAAGCAAAATAACAACAACAGGAAA
CFTR-C004   TGGGAGGAGGGGTTCGGCGAGCTGTTTGAGAAGGCCAAACAGAATAACAACAACAGGAAG
CFTR-C029   TGGGAGGAGGGGTTCGGCGAGCTGTTTGAGAAGGCCAAACAGAATAACAACAACAGGAAG
CFTR-C021   TGGGAGGAGGGTTTCGGCGAGCTGTTCGAGAAAGCCAAGCAGAACAACAACAACAGGAAG
CFTR-C046   TGGGAGGAGGGTTTCGGCGAGCTGTTCGAGAAAGCCAAGCAGAACAACAACAACAGGAAG
CFTR-C008   TGGGAAGAGGGCTTTGGCGAGCTGTTTGAGAAGGCCAAGCAGAATAACAACAACCGTAAG
CFTR-C033   TGGGAAGAGGGCTTTGGCGAGCTGTTTGAGAAGGCCAAGCAGAATAACAACAACCGTAAG
CFTR-C022   TGGGAGGAGGGCTTTGGCGAGCTGTTCGAGAAGGCCAAGCAGAACAACAACAATAGGAAA
CFTR-C047   TGGGAGGAGGGCTTTGGCGAGCTGTTCGAGAAGGCCAAGCAGAACAACAACAATAGGAAA
CFTR-C017   TGGGAGGAAGGCTTCGGCGAGCTGTTCGAGAAGGCGAAGCAGAACAACAACAACCGCAAG
CFTR-C042   TGGGAGGAAGGCTTCGGCGAGCTGTTCGAGAAGGCGAAGCAGAACAACAACAACCGCAAG
CFTR-C020   TGGGAGGAGGGCTTCGGCGAGCTGTTTGAAAAGGCGAAACAGAACAATAACAACCGCAAG
CFTR-C045   TGGGAGGAGGGCTTCGGCGAGCTGTTTGAAAAGGCGAAACAGAACAATAACAACCGCAAG
CFTR-C013   TGGGAGGAAGGGTTCGGCGAGCTGTTCGAGAAAGCCAAACAAAATAACAACAATCGAAAG
CFTR-C038   TGGGAGGAAGGGTTCGGCGAGCTGTTCGAGAAAGCCAAACAAAATAACAACAATCGAAAG
CFTR-C002   TGGGAGGAGGGTTTCGGCGAGCTGTTTGAAAAGCCAAGCAGAACAACAACAACCGTAAG
CFTR-C027   TGGGAGGAGGGTTTCGGCGAGCTGTTTGAAAAGCCAAGCAGAACAACAACAACCGTAAG
CFTR-C011   TGGGAGGAGGGTTTCGGGGAACTGTTCGAGAAGGCCAAGCAGAACAACAACAACAGGAAG
CFTR-C036   TGGGAGGAGGGTTTCGGGGAACTGTTCGAGAAGGCCAAGCAGAACAACAACAACAGGAAG
CFTR-C005   TGGGAGGAAGGCTTCGGGGAGCTCTTCGAGAAAGCGAAGCAGAACAACAACAACAGGAAG
CFTR-C030   TGGGAGGAAGGCTTCGGGGAGCTCTTCGAGAAAGCGAAGCAGAACAACAACAACAGGAAG
CFTR-C006   TGGGAGGAGGGCTTCGGCGAGCTGTTCGAAAAGGCCAAGCAGAACAACAACAACCGGAAG
CFTR-C031   TGGGAGGAGGGCTTCGGCGAGCTGTTCGAAAAGGCCAAGCAGAACAACAACAACCGGAAG
CFTR-C018   TGGGAAGAGGGATTCGGCGAGCTCTTCGAGAAGGCCAAGCAGAACAACAACAACCGGAAG
CFTR-C043   TGGGAAGAGGGATTCGGCGAGCTCTTCGAGAAGGCCAAGCAGAACAACAACAACCGGAAG
CFTR-C003   TGGGAGGAAGGCTTCGGGGAGCTCTTCGAGAAGGCCAAGCAGAATAACAACAACCGGAAA
CFTR-C028   TGGGAGGAAGGCTTCGGGGAGCTCTTCGAGAAGGCCAAGCAGAATAACAACAACCGGAAA
CFTR-C016   TGGGAGGAGGGCTTCGGGGAACTCTTCGAAAAGGCCAAGCAGAATAACAACAACAGGAAG
CFTR-C041   TGGGAGGAGGGCTTCGGGGAACTCTTCGAAAAGGCCAAGCAGAATAACAACAACAGGAAG
CFTR-C010   TGGGAGGAGGGCTTTGGAGAGCTCTTTGAGAAGGCCAAGCAGAACAACAACAACCGGAAG
CFTR-C035   TGGGAGGAGGGCTTTGGAGAGCTCTTTGAGAAGGCCAAGCAGAACAACAACAACCGGAAG
CFTR-C012   TGGGAGGAAGGCTTCGGAGAGCTGTTCGAGAAAGCCAAACAGAACAACAACAACAGGAAG
CFTR-C037   TGGGAGGAAGGCTTCGGAGAGCTGTTCGAGAAAGCCAAACAGAACAACAACAACAGGAAG
CFTR-C009   TGGGAGGAGGGCTTCGGGGAGCTCTTTGAAAAGGCCAAGCAGAATAACAACAATAGGAAG
CFTR-C034   TGGGAGGAGGGCTTCGGGGAGCTCTTTGAAAAGGCCAAGCAGAATAACAACAATAGGAAG
CFTR-C015   TGGGAGGAGGGGTTTGGGGAACTGTTTGAAAAGGCCAAGCAGAATAACAACAACCGGAAG
CFTR-C040   TGGGAGGAGGGGTTTGGGGAACTGTTTGAAAAGGCCAAGCAGAATAACAACAACCGGAAG
CFTR-C019   TGGGAGGAGGGCTTCGGCGAGCTCTTCGAAAAGGCCAAGCAAAACAACAACAACAGGAAG
CFTR-C044   TGGGAGGAGGGCTTCGGCGAGCTCTTCGAAAAGGCCAAGCAAAACAACAACAACAGGAAG
CFTR-C007   TGGGAAGAGGGCTTCGGCGAGCTGTTCGAGAAGGCCAAGCAGAACAATAACAACCGGAAG
CFTR-C032   TGGGAAGAGGGCTTCGGCGAGCTGTTCGAGAAGGCCAAGCAGAACAATAACAACCGGAAG
CFTR-C014   TGGGAGGAAGGCTTTGGCGAACTGTTCGAGAAGGCCAAGCAGAACAACAACAACCGCAAA
CFTR-C039   TGGGAGGAAGGCTTTGGCGAACTGTTCGAGAAGGCCAAGCAGAACAACAACAACCGCAAA
CFTR-C025   TGGGAGGAAGGCTTTGGGGAACTGTTCGAGAAAGCCAAACAGAACAATAACAACAGGAAG
CFTR-C050   TGGGAGGAAGGCTTTGGGGAACTGTTCGAGAAAGCCAAACAGAACAATAACAACAGGAAG
CFTR-C023   TGGGAGGAGGGCTTCGGCGAGCTGTTCGAGAAGGCCAAGCAAAACAATAACAACAGGAAG
CFTR-C048   TGGGAGGAGGGCTTCGGCGAGCTGTTCGAGAAGGCCAAGCAAAACAATAACAACAGGAAG
CFTR-C024   TGGGAGGAGGGCTTCGGCGAGCTGTTCGAAAAGGCCAAGCAGAACAATAATAACCGGAAG
CFTR-C049   TGGGAGGAGGGCTTCGGCGAGCTGTTCGAAAAGGCCAAGCAGAACAATAATAACCGGAAG
            *****.** .** **.** **  ** **.** **.** **.** **,**.**.   * **.
```

FIG. 10 (cont)

```
CFTR-WT   ACTTCTAATGGTGATGACAGCCTCTTCTTCAGTAATTTCTCACTTCTTGGTACTCCTGTC
CFTR-C001 ACCAGCAATGGCGACGACTCCCTGTTTTTTTCCAACTTTAGTCTGCTGGGCACCCCAGTA
CFTR-C026 ACCAGCAATGGCGACGACTCCCTGTTTTTTTCCAACTTTAGTCTGCTGGGCACCCCAGTA
CFTR-C004 ACCAGCAACGGCGATGACAGCCTGTTCTTCTCGAACTTCAGCCTGCTGGGCACCCCCGTG
CFTR-C029 ACCAGCAACGGCGATGACAGCCTGTTCTTCTCGAACTTCAGCCTGCTGGGCACCCCCGTG
CFTR-C021 ACCAGCAACGGCGACGACTCCCTGTTCTTCAGCAACTTTAGCCTCCTGGGCACCCCCGTG
CFTR-C046 ACCAGCAACGGCGACGACTCCCTGTTCTTCAGCAACTTTAGCCTCCTGGGCACCCCCGTG
CFTR-C008 ACAAGCAACGGCGACGATAGCCTGTTCTTCAGCAATTTCTCCCTGCTCGGCACCCCCGTG
CFTR-C033 ACAAGCAACGGCGACGATAGCCTGTTCTTCAGCAATTTCTCCCTGCTCGGCACCCCCGTG
CFTR-C022 ACCAGCAACGGCGACGATAGCCTGTTCTTCAGCAACTTCTCCCTGCTGGGGACGCCCGTC
CFTR-C047 ACCAGCAACGGCGACGATAGCCTGTTCTTCAGCAACTTCTCCCTGCTGGGGACGCCCGTC
CFTR-C017 ACCAGCAATGGTGACGACTCGCTCTTCTTCTCAAACTTCAGCCTACTGGGCACGCCCGTG
CFTR-C042 ACCAGCAATGGTGACGACTCGCTCTTCTTCTCAAACTTCAGCCTACTGGGCACGCCCGTG
CFTR-C020 ACCAGCAACGGCGACGACTCCCTGTTCTTTAGCAACTTCAGTCTGCTGGGCACCCCGGTG
CFTR-C045 ACCAGCAACGGCGACGACTCCCTGTTCTTTAGCAACTTCAGTCTGCTGGGCACCCCGGTG
CFTR-C013 ACCTCCAACGGCGACGACAGCCTGTTCTTCAGCAATTTTAGCCTGCTGGGCACCCCCGTG
CFTR-C038 ACCTCCAACGGCGACGACAGCCTGTTCTTCAGCAATTTTAGCCTGCTGGGCACCCCCGTG
CFTR-C002 ACCTCCAACGGTGACGACAGCCTCTTTTTCTCCAACTTCAGCCTGCTCGGCACTCCCGTC
CFTR-C027 ACCTCCAACGGTGACGACAGCCTCTTTTTCTCCAACTTCAGCCTGCTCGGCACTCCCGTC
CFTR-C011 ACGAGCAATGGCGATGATAGCCTGTTCTTCAGCAACTTCAGCCTCCTGGGGACCCCCGTG
CFTR-C036 ACGAGCAATGGCGATGATAGCCTGTTCTTCAGCAACTTCAGCCTCCTGGGGACCCCCGTG
CFTR-C005 ACGAGCAACGGGGACGACAGCCTGTTTTTCAGCAATTTTCCCTGCTGGGCACGCCCGTG
CFTR-C030 ACGAGCAACGGGGACGACAGCCTGTTTTTCAGCAATTTTCCCTGCTGGGCACGCCCGTG
CFTR-C006 ACCAGCAACGGCGACGATTCCCTGTTCTTCAGCAACTTCAGCCTGCTGGGCACCCCTGTC
CFTR-C031 ACCAGCAACGGCGACGATTCCCTGTTCTTCAGCAACTTCAGCCTGCTGGGCACCCCTGTC
CFTR-C018 ACCAGCAATGGCGATGATTCCCTGTTCTTCAGCAACTTCAGCCTGCTGGGGACCCCCGTA
CFTR-C043 ACCAGCAATGGCGATGATTCCCTGTTCTTCAGCAACTTCAGCCTGCTGGGGACCCCCGTA
CFTR-C003 ACCAGCAATGGCGACGACAGCCTGTTCTTCAGCAACTTTCCCTCCTGGGCACCCCCGTG
CFTR-C028 ACCAGCAATGGCGACGACAGCCTGTTCTTCAGCAACTTTCCCTCCTGGGCACCCCCGTG
CFTR-C016 ACGTCCAACGGAGACGACTCCCTCTTCTTCAGCAACTTCAGCCTGCTGGGGACCCCCGTC
CFTR-C041 ACGTCCAACGGAGACGACTCCCTCTTCTTCAGCAACTTCAGCCTGCTGGGGACCCCCGTC
CFTR-C010 ACCAGCAACGGCGACGACTCTCTGTTTTTTAGCAACTTTAGCCTGCTGGGGACCCCCGTG
CFTR-C035 ACCAGCAACGGCGACGACTCTCTGTTTTTTAGCAACTTTAGCCTGCTGGGGACCCCCGTG
CFTR-C012 ACCTCCAACGGCGATGATTCGCTGTTCTTCAGCAATTCAGCCTCCTGGGCACCCCCGTG
CFTR-C037 ACCTCCAACGGCGATGATTCGCTGTTCTTCAGCAATTTCAGCCTCCTGGGCACCCCCGTG
CFTR-C009 ACGAGCAATGGCGACGACAGCCTCTTCTTCAGCAACTTCAGCCTGCTGGGGACGCCCGTG
CFTR-C034 ACGAGCAATGGCGACGACAGCCTCTTCTTCAGCAACTTCAGCCTGCTGGGGACGCCCGTG
CFTR-C015 ACCAGCAACGGCGACGACAGCCTGTTCTTCAGCAACTTCAGCCTGCTCGGCACCCCCGTG
CFTR-C040 ACCAGCAACGGCGACGACAGCCTGTTCTTCAGCAACTTCAGCCTGCTCGGCACCCCCGTG
CFTR-C019 ACCTCCAATGGCGACGACAGCCTGTTCTTCAGCAACTTCAGCCTGCTCGGGACCCCGGTG
CFTR-C044 ACCTCCAATGGCGACGACAGCCTGTTCTTCAGCAACTTCAGCCTGCTCGGGACCCCGGTG
CFTR-C007 ACCAGCAACGGAGACGACAGCCTGTTCTTTAGCAACTTCAGCCTGCTCGGGACCCCCGTG
CFTR-C032 ACCAGCAACGGAGACGACAGCCTGTTCTTTAGCAACTTCAGCCTGCTCGGGACCCCCGTG
CFTR-C014 ACCAGCAACGGGGATGACAGCCTGTTCTTCAGCAACTTCTCCCTGCTCGGAACTCCCGTG
CFTR-C039 ACCAGCAACGGGGATGACAGCCTGTTCTTCAGCAACTTCTCCCTGCTCGGAACTCCCGTG
CFTR-C025 ACCAGCAACGGGGATGACTCCCTCTTCTTCTCCAACTTCAGCCTCCTGGGGACACCCGTC
CFTR-C050 ACCAGCAACGGGGATGACTCCCTCTTCTTCTCCAACTTCAGCCTCCTGGGGACACCCGTC
CFTR-C023 ACGAGCAACGGGGATGACAGCCTCTTCTTCAGCAACTTTCCCTGCTGGGGACTCCCGTC
CFTR-C048 ACGAGCAACGGGGATGACAGCCTCTTCTTCAGCAACTTTCCCTGCTGGGGACTCCCGTC
CFTR-C024 ACCAGCAACGGCGACGACTCCCTCTTCTTCAGCAATTCTCCCTCCTGGGCACCCCCGTG
CFTR-C049 ACCAGCAACGGCGACGACTCCCTCTTCTTCAGCAATTCTCCCTCCTGGGCACCCCCGTG
          **   ,**,**,**,**,   ** **,**,   **,**,    ** ** ** ** ** **
```

FIG. 10 (cont)

```
CFTR-WT     CTGAAAGATATTAATTTCAAGATAGAAAGAGGACAGTTGTTGGCGGTTGCTGGATCCACT
CFTR-C001   CTGAAGGACATCAACTTCAAGATCGAGCGAGGCCAGCTCCTGGCCGTGGCCGGGAGCACC
CFTR-C026   CTGAAGGACATCAACTTCAAGATCGAGCGAGGCCAGCTCCTGGCCGTGGCCGGGAGCACC
CFTR-C004   CTGAAGGATATCAACTTCAAGATCGAGAGGGGCCAGCTGCTGGCCGTGGCCGGGAGCACC
CFTR-C029   CTGAAGGATATCAACTTCAAGATCGAGAGGGGCCAGCTGCTGGCCGTGGCCGGGAGCACC
CFTR-C021   CTGAAGGACATCAATTTCAAGATCGAGAGGGGCCAGCTGCTGGCCGTGGCCGGTAGCACC
CFTR-C046   CTGAAGGACATCAATTTCAAGATCGAGAGGGGCCAGCTGCTGGCCGTGGCCGGTAGCACC
CFTR-C008   CTGAAAGATATCAACTTCAAAATCGAGCGCGGGCAGCTGCTCGCCGTGGCCGGGTCCACC
CFTR-C033   CTGAAAGATATCAACTTCAAAATCGAGCGCGGGCAGCTGCTCGCCGTGGCCGGGTCCACC
CFTR-C022   CTGAAGGACATAAACTTCAAGATCGAGAGGGGCCAGCTGCTGGCCGTGGCCGGCAGCACC
CFTR-C047   CTGAAGGACATAAACTTCAAGATCGAGAGGGGCCAGCTGCTGGCCGTGGCCGGCAGCACC
CFTR-C017   CTGAAGGACATTAACTTCAAGATCGAGCGGGGACAGCTGCTCGCCGTGGCCGGAAGCACC
CFTR-C042   CTGAAGGACATTAACTTCAAGATCGAGCGGGGACAGCTGCTCGCCGTGGCCGGAAGCACC
CFTR-C020   CTGAAGGACATCAACTTTAAGATCGAGAGGGGACAGCTGCTCGCCGTGGCCGGTAGCACC
CFTR-C045   CTGAAGGACATCAACTTTAAGATCGAGAGGGGACAGCTGCTCGCCGTGGCCGGTAGCACC
CFTR-C013   CTGAAGGACATCAATTTCAAGATCGAAAGGGGCCAACTGCTGGCCGTGGCCGGGAGCACC
CFTR-C038   CTGAAGGACATCAATTTCAAGATCGAAAGGGGCCAACTGCTGGCCGTGGCCGGGAGCACC
CFTR-C002   CTGAAGGACATCAATTTCAAGATTGAACGGGGCAGCTCCTGGCCGTGGCCGGGAGCACC
CFTR-C027   CTGAAGGACATCAATTTCAAGATTGAACGGGGCAGCTCCTGGCCGTGGCCGGGAGCACC
CFTR-C011   CTGAAGGACATCAACTTTAAGATCGAGCGAGGCCAGCTGCTGGCCGTGGCCGGCTCCACC
CFTR-C036   CTGAAGGACATCAACTTTAAGATCGAGCGAGGCCAGCTGCTGGCCGTGGCCGGCTCCACC
CFTR-C005   CTGAAAGATATCAACTTCAAGATCGAGAGGGGCAACTGCTGGCCGTGGCCGGGAGCACC
CFTR-C030   CTGAAAGATATCAACTTCAAGATCGAGAGGGGCAACTGCTGGCCGTGGCCGGGAGCACC
CFTR-C006   CTCAAAGACATCAACTTCAAGATCGAGCGGGGCAGCTCCTGGCCGTCGCCGGAAGCACC
CFTR-C031   CTCAAAGACATCAACTTCAAGATCGAGCGGGGCAGCTCCTGGCCGTCGCCGGAAGCACC
CFTR-C018   CTGAAGGACATCAACTTCAAGATCGAGAGAGGCCAGCTGCTGGCCGTAGCCGGGAGCACC
CFTR-C043   CTGAAGGACATCAACTTCAAGATCGAGAGAGGCCAGCTGCTGGCCGTAGCCGGGAGCACC
CFTR-C003   CTGAAGGATATCAACTTTAAGATCGAGAGGGGCCAGCTGCTGGCCGTGGCCGGGAGCACC
CFTR-C028   CTGAAGGATATCAACTTTAAGATCGAGAGGGGCCAGCTGCTGGCCGTGGCCGGGAGCACC
CFTR-C016   CTGAAAGACATCAATTTCAAAATCGAGCGGGGCCAGCTCCTGGCCGTGGCCGGGAGCACC
CFTR-C041   CTGAAAGACATCAATTTCAAAATCGAGCGGGGCCAGCTCCTGGCCGTGGCCGGGAGCACC
CFTR-C010   CTGAAGGACATCAACTTCAAGATCGAGAGGGGCCAGCTCCTGGCCGGTGGCCGGCAGCACC
CFTR-C035   CTGAAGGACATCAACTTCAAGATCGAGAGGGGCCAGCTCCTGGCCGGTGGCCGGCAGCACC
CFTR-C012   CTCAAGGACATCAACTTCAAAATCGAGAGGGGCAGCTGCTGGCCGTGGCGGGTAGCACC
CFTR-C037   CTCAAGGACATCAACTTCAAAATCGAGAGGGGCAGCTGCTGGCCGTGGCGGGTAGCACC
CFTR-C009   CTCAAAGACATCAACTTCAAGATCGAGCGGGGCAGCTGCTGGCCGTGGCCGGAAGCACG
CFTR-C034   CTCAAAGACATCAACTTCAAGATCGAGCGGGGCAGCTGCTGGCCGTGGCCGGAAGCACG
CFTR-C015   CTGAAGGACATCAATTTCAAGATCGAGAGGGGCCAGCTGCTGGCCGTCGCGGGCAGCACT
CFTR-C040   CTGAAGGACATCAATTTCAAGATCGAGAGGGGCCAGCTGCTGGCCGTCGCGGGCAGCACT
CFTR-C019   CTGAAGGACATTAATTTCAAAATCGAGCGGGGCCAGCTGCTGGCCGTGGCCGGCTCCACA
CFTR-C044   CTGAAGGACATTAATTTCAAAATCGAGCGGGGCCAGCTGCTGGCCGTGGCCGGCTCCACA
CFTR-C007   CTGAAGGACATCAACTTCAAAATCGAGAGGGGCCAGCTGCTGGCCGTCGCCGGATCCACT
CFTR-C032   CTGAAGGACATCAACTTCAAAATCGAGAGGGGCCAGCTGCTGGCCGTCGCCGGATCCACT
CFTR-C014   CTGAAGGACATCAACTTCAAGATAGAGCGCGGCCAGCTCCTGGCCGTGGCCGGCTCCACC
CFTR-C039   CTGAAGGACATCAACTTCAAGATAGAGCGCGGCCAGCTCCTGGCCGTGGCCGGCTCCACC
CFTR-C025   CTGAAGGATATCAATTTCAAGATCGAGCGCGGCCAACTCCTGGCCGTGGCCGGCAGCACC
CFTR-C050   CTGAAGGATATCAATTTCAAGATCGAGCGCGGCCAACTCCTGGCCGTGGCCGGCAGCACC
CFTR-C023   CTGAAGGATATCAACTTCAAGATCGAAAGGGGACAGCTGCTGGCCGTCGCCGGCAGCACC
CFTR-C048   CTGAAGGATATCAACTTCAAGATCGAAAGGGGACAGCTGCTGGCCGTCGCCGGCAGCACC
CFTR-C024   CTCAAGGACATCAATTTTAAGATCGAGAGGGGCCAGCTGCTGGCCGTGGCCGGCTCCACC
CFTR-C049   CTCAAGGACATCAATTTTAAGATCGAGAGGGGCCAGCTGCTGGCCGTGGCCGGCTCCACC
            ** ** ** ** ** ** ** ** ** **  *  ** ** * * ** ** ** **   ***
```

FIG. 10 (cont)

| | |
|---|---|
| CFTR-WT | GGAGCAGGCAAGACTTCACTTCTAATGGTGATTATGGGAGAACTGGAGCCTTCAGAGGGT |
| CFTR-C001 | GGCGCCGGAAAGACCTCCCTGCTGATGGTGATCATGGGCGAGCTCGAGCCGTCCGAGGGC |
| CFTR-C026 | GGCGCCGGAAAGACCTCCCTGCTGATGGTGATCATGGGCGAGCTCGAGCCGTCCGAGGGC |
| CFTR-C004 | GGCGCCGGCAAGACCAGCCTGCTGATGGTGATCATGGGGGAGCTGGAGCCGAGCGAGGGT |
| CFTR-C029 | GGCGCCGGCAAGACCAGCCTGCTGATGGTGATCATGGGGGAGCTGGAGCCGAGCGAGGGT |
| CFTR-C021 | GGCGCCGGGAAAACCAGCCTGCTGATGGTGATCATGGGCGAGCTGGAGCCCAGCGAGGGA |
| CFTR-C046 | GGCGCCGGGAAAACCAGCCTGCTGATGGTGATCATGGGCGAGCTGGAGCCCAGCGAGGGA |
| CFTR-C008 | GGGGCCGGCAAGACCAGCCTGCTGATGGTGATCATGGGCGAGCTGGAACCCTCCGAGGGC |
| CFTR-C033 | GGGGCCGGCAAGACCAGCCTGCTGATGGTGATCATGGGCGAGCTGGAACCCTCCGAGGGC |
| CFTR-C022 | GGCGCCGGGAAGACGAGCCTCCTGATGGTAATCATGGGCGAGCTGGAGCCCTCCGAAGGC |
| CFTR-C047 | GGCGCCGGGAAGACGAGCCTCCTGATGGTAATCATGGGCGAGCTGGAGCCCTCCGAAGGC |
| CFTR-C017 | GGCGCCGGCAAGACCAGTCTGCTGATGGTGATCATGGGCGAGCTGGAGCCCAGCGAGGGG |
| CFTR-C042 | GGCGCCGGCAAGACCAGTCTGCTGATGGTGATCATGGGCGAGCTGGAGCCCAGCGAGGGG |
| CFTR-C020 | GGCGCCGGCAAGACCAGCCTGCTGATGGTGATCATGGGCGAGCTGGAGCCCAGCGAGGGC |
| CFTR-C045 | GGCGCCGGCAAGACCAGCCTGCTGATGGTGATCATGGGCGAGCTGGAGCCCAGCGAGGGC |
| CFTR-C013 | GGGGCGGGAAAGACCTCCCTTCTGATGGTGATCATGGGCGAGCTCGAGCCCAGCGAGGGG |
| CFTR-C038 | GGGGCGGGAAAGACCTCCCTTCTGATGGTGATCATGGGCGAGCTCGAGCCCAGCGAGGGG |
| CFTR-C002 | GGAGCCGGGAAGACCAGCCTGCTGATGGTCATCATGGGCGAACTGGAGCCCTCCGAGGGC |
| CFTR-C027 | GGAGCCGGGAAGACCAGCCTGCTGATGGTCATCATGGGCGAACTGGAGCCCTCCGAGGGC |
| CFTR-C011 | GGAGCCGGCAAGACATCATTGCTGATGGTGATCATGGGCGAACTCGAACCCAGCGAGGGG |
| CFTR-C036 | GGAGCCGGCAAGACATCATTGCTGATGGTGATCATGGGCGAACTCGAACCCAGCGAGGGG |
| CFTR-C005 | GGCGCCGGCAAGACCAGCCTGCTGATGGTGATCATGGGCGAGCTCGAGCCCAGCGAGGGG |
| CFTR-C030 | GGCGCCGGCAAGACCAGCCTGCTGATGGTGATCATGGGCGAGCTCGAGCCCAGCGAGGGG |
| CFTR-C006 | GGCGCGGGCAAGACCAGCCTTCTAATGGTGATCATGGGTGAACTGGAGCCCAGTGAGGGA |
| CFTR-C031 | GGCGCGGGCAAGACCAGCCTTCTAATGGTGATCATGGGTGAACTGGAGCCCAGTGAGGGA |
| CFTR-C018 | GGGGCGGGCAAAACCTCCCTCCTGATGGTGATCATGGGAGAGCTGGAGCCGTCCGAGGGC |
| CFTR-C043 | GGGGCGGGCAAAACCTCCCTCCTGATGGTGATCATGGGAGAGCTGGAGCCGTCCGAGGGC |
| CFTR-C003 | GGCGCCGGCAAAACGAGCCTGCTGATGGTCATCATGGGCGAGCTGGAACCCAGCGAGGGC |
| CFTR-C028 | GGCGCCGGCAAAACGAGCCTGCTGATGGTCATCATGGGCGAGCTGGAACCCAGCGAGGGC |
| CFTR-C016 | GGTGCCGGAAGACGAGCCTGCTGATGGTGATCATGGGTGAGCTGGAGCCCTCCGAGGGG |
| CFTR-C041 | GGTGCCGGAAGACGAGCCTGCTGATGGTGATCATGGGTGAGCTGGAGCCCTCCGAGGGG |
| CFTR-C010 | GGAGCCGGCAAAACCTCCCTCCTGATGGTCATCATGGGCGAACTGGAACCCAGCGAGGGC |
| CFTR-C035 | GGAGCCGGCAAAACCTCCCTCCTGATGGTCATCATGGGCGAACTGGAACCCAGCGAGGGC |
| CFTR-C012 | GGCGCCGGCAAGACAAGCCTGCTCATGGTCATCATGGGCGAGCTGGAGCCCAGCGAGGGG |
| CFTR-C037 | GGCGCCGGCAAGACAAGCCTGCTCATGGTCATCATGGGCGAGCTGGAGCCCAGCGAGGGG |
| CFTR-C009 | GGAGCCGGCAAGACCAGCCTGCTGATGGTGATCATGGGGGAGCTCGAACCCTCCGAAGGC |
| CFTR-C034 | GGAGCCGGCAAGACCAGCCTGCTGATGGTGATCATGGGGGAGCTCGAACCCTCCGAAGGC |
| CFTR-C015 | GGCGCGGGCAAGACCTCCCTGCTAATGGTAATCATGGGCGAGCTCGAACCCTCCGAGGGG |
| CFTR-C040 | GGCGCGGGCAAGACCTCCCTGCTAATGGTAATCATGGGCGAGCTCGAACCCTCCGAGGGG |
| CFTR-C019 | GGGGCTGGCAAGACCAGCCTCCTGATGGTGATCATGGGGGAACTCGAGCCCTCCGAGGGC |
| CFTR-C044 | GGGGCTGGCAAGACCAGCCTCCTGATGGTGATCATGGGGGAACTCGAGCCCTCCGAGGGC |
| CFTR-C007 | GGAGCCGGCAAGACCTCCCTGCTGATGGTTATCATGGGCGAGCTGGAACCAAGCGAAGGT |
| CFTR-C032 | GGAGCCGGCAAGACCTCCCTGCTGATGGTTATCATGGGCGAGCTGGAACCAAGCGAAGGT |
| CFTR-C014 | GGCGCCGGCAAGACCAGCCTGCTCATGGTGATAATGGGGAACTGGAGCCCTCGGAGGGG |
| CFTR-C039 | GGCGCCGGCAAGACCAGCCTGCTCATGGTGATAATGGGGAACTGGAGCCCTCGGAGGGG |
| CFTR-C025 | GGTGCCGGTAAGACCAGCCTGCTGATGGTCATCATGGGCGAGCTGGAGCCGAGCGAAGGC |
| CFTR-C050 | GGTGCCGGTAAGACCAGCCTGCTGATGGTCATCATGGGCGAGCTGGAGCCGAGCGAAGGC |
| CFTR-C023 | GGGGCCGGCAAGACAAGCCTGCTGATGGTCATCATGGGCGAACTGGAGCCTAGCGAGGGC |
| CFTR-C048 | GGGGCCGGCAAGACAAGCCTGCTGATGGTCATCATGGGCGAACTGGAGCCTAGCGAGGGC |
| CFTR-C024 | GGCGCCGGCAAAACCTCCCTGCTCATGGTGATCATGGGGGAGCTCGAGCCTAGCGAGGGC |
| CFTR-C049 | GGCGCCGGCAAAACCTCCCTGCTCATGGTGATCATGGGGGAGCTCGAGCCTAGCGAGGGC |
| | ** ** ** ** ** * ** ***** ** ***** ** ** ** ** ** ** |

FIG. 10 (cont)

```
CFTR-WT   AAAATTAAGCACAGTGGAAGAATTTCATTCTGTTCTCAGTTTTCCTGGATTATGCCTGGC
CFTR-C001 AAGATCAAGCACAGCGGCCGGATCAGCTTCTGCAGCCAATTCAGCTGGATCATGCCCGGC
CFTR-C026 AAGATCAAGCACAGCGGCCGGATCAGCTTCTGCAGCCAATTCAGCTGGATCATGCCCGGC
CFTR-C004 AAGATCAAGCACAGCGGGAGGATCTCCTTTTGCTCCCAGTTCTCCTGGATCATGCCGGGC
CFTR-C029 AAGATCAAGCACAGCGGGAGGATCTCCTTTTGCTCCCAGTTCTCCTGGATCATGCCGGGC
CFTR-C021 AAGATCAAACACAGCGGGAGGATCTCCTTCTGCTCCCAGTTCAGCTGGATCATGCCGGGC
CFTR-C046 AAGATCAAACACAGCGGGAGGATCTCCTTCTGCTCCCAGTTCAGCTGGATCATGCCGGGC
CFTR-C008 AAGATCAAACATAGCGGCCGGATCAGCTTCTGCAGCCAGTTCTCCTGGATCATGCCCGGC
CFTR-C033 AAGATCAAACATAGCGGCCGGATCAGCTTCTGCAGCCAGTTCTCCTGGATCATGCCCGGC
CFTR-C022 AAGATCAAGCATTCCGGCAGAATCAGCTTCTGCTCCCAGTTCTCGTGGATTATGCCCGGC
CFTR-C047 AAGATCAAGCATTCCGGCAGAATCAGCTTCTGCTCCCAGTTCTCGTGGATTATGCCCGGC
CFTR-C017 AAGATAAAGCACAGCGGGAGGATCAGCTTCTGCAGCCAGTTCAGCTGGATCATGCCCGGC
CFTR-C042 AAGATAAAGCACAGCGGGAGGATCAGCTTCTGCAGCCAGTTCAGCTGGATCATGCCCGGC
CFTR-C020 AAAATAAAGCACAGCGGCAGGATCAGCTTTTGTAGCCAGTTCAGCTGGATCATGCCCGGC
CFTR-C045 AAAATAAAGCACAGCGGCAGGATCAGCTTTTGTAGCCAGTTCAGCTGGATCATGCCCGGC
CFTR-C013 AAGATCAAGCACAGTGGAAGGATAAGCTTCTGCAGCCAATTCAGCTGGATCATGCCGGGG
CFTR-C038 AAGATCAAGCACAGTGGAAGGATAAGCTTCTGCAGCCAATTCAGCTGGATCATGCCGGGG
CFTR-C002 AAAATCAAGCACAGCGGCAGGATCAGCTTCTGCAGCCAGTTCAGCTGGATCATGCCTGGC
CFTR-C027 AAAATCAAGCACAGCGGCAGGATCAGCTTCTGCAGCCAGTTCAGCTGGATCATGCCTGGC
CFTR-C011 AAGATCAAGCACTCCGGGAGGATCTCCTTCTGCAGCCAATTCAGCTGGATCATGCCGGGC
CFTR-C036 AAGATCAAGCACTCCGGGAGGATCTCCTTCTGCAGCCAATTCAGCTGGATCATGCCGGGC
CFTR-C005 AAGATCAAGCACTCCGGGCGGATCAGCTTCTGCAGCCAGTTTAGCTGGATAATGCCCGGC
CFTR-C030 AAGATCAAGCACTCCGGGCGGATCAGCTTCTGCAGCCAGTTTAGCTGGATAATGCCCGGC
CFTR-C006 AAGATAAAGCACAGCGGCCGGATAAGCTTCTGCTCACAATTCTCCTGGATCATGCCCGGC
CFTR-C031 AAGATAAAGCACAGCGGCCGGATAAGCTTCTGCTCACAATTCTCCTGGATCATGCCCGGC
CFTR-C018 AAGATCAAGCATAGCGGTAGGATCTCCTTTTGTTCCCAGTTCTCGTGGATAATGCCGGGC
CFTR-C043 AAGATCAAGCATAGCGGTAGGATCTCCTTTTGTTCCCAGTTCTCGTGGATAATGCCGGGC
CFTR-C003 AAGATTAAGCACTCCGGCCGGATCTCTTTCTGTTCCCAGTTCAGCTGGATCATGCCCGGC
CFTR-C028 AAGATTAAGCACTCCGGCCGGATCTCTTTCTGTTCCCAGTTCAGCTGGATCATGCCCGGC
CFTR-C016 AAGATCAAGCACAGCGGGCGTATAAGCTTCTGTAGCCAGTTCTCGTGGATCATGCCCGGC
CFTR-C041 AAGATCAAGCACAGCGGGCGTATAAGCTTCTGTAGCCAGTTCTCGTGGATCATGCCCGGC
CFTR-C010 AAAATCAAGCACTCCGGCCGAATCTCCTTCTGCTCCCAGTTCTCCTGGATAATGCCCGGT
CFTR-C035 AAAATCAAGCACTCCGGCCGAATCTCCTTCTGCTCCCAGTTCTCCTGGATAATGCCCGGT
CFTR-C012 AAAATCAAGCACAGCGGGCGGATCAGCTTCTGCTCACAGTTCAGTTGGATCATGCCCGGG
CFTR-C037 AAAATCAAGCACAGCGGGCGGATCAGCTTCTGCTCACAGTTCAGTTGGATCATGCCCGGG
CFTR-C009 AAGATCAAGCATAGCGGGAGGATCAGCTTCTGCAGCCAGTTCTCCTGGATAATGCCAGGG
CFTR-C034 AAGATCAAGCATAGCGGGAGGATCAGCTTCTGCAGCCAGTTCTCCTGGATAATGCCAGGG
CFTR-C015 AAAATCAAGCACAGCGGGCGGATCAGCTTCTGTTCCCAATTCAGCTGGATAATGCCCGGG
CFTR-C040 AAAATCAAGCACAGCGGGCGGATCAGCTTCTGTTCCCAATTCAGCTGGATAATGCCCGGG
CFTR-C019 AAGATCAAGCACTCCGGCAGGATCAGCTTCTGCAGCCAGTTTAGCTGGATCATGCCCGGC
CFTR-C044 AAGATCAAGCACTCCGGCAGGATCAGCTTCTGCAGCCAGTTTAGCTGGATCATGCCCGGC
CFTR-C007 AAAATCAAGCACTCCGGCCGAATCTCCTTCTGTAGCCAGTTCAGCTGGATCATGCCCGGC
CFTR-C032 AAAATCAAGCACTCCGGCCGAATCTCCTTCTGTAGCCAGTTCAGCTGGATCATGCCCGGC
CFTR-C014 AAGATCAAACACTCCGGCCGAATAAGCTTCTGTAGCCAGTTCTCCTGGATCATGCCCGGC
CFTR-C039 AAGATCAAACACTCCGGCCGAATAAGCTTCTGTAGCCAGTTCTCCTGGATCATGCCCGGC
CFTR-C025 AAGATCAAACACAGTGGCCGGATCAGCTTTTGCAGCCAGTTCTCCTGGATTATGCCTGGC
CFTR-C050 AAGATCAAACACAGTGGCCGGATCAGCTTTTGCAGCCAGTTCTCCTGGATTATGCCTGGC
CFTR-C023 AAGATCAAACACAGCGGGAGGATCTCCTTCTGCTCCCAGTTCAGCTGGATCATGCCCGGC
CFTR-C048 AAGATCAAACACAGCGGGAGGATCTCCTTCTGCTCCCAGTTCAGCTGGATCATGCCCGGC
CFTR-C024 AAGATCAAACACAGCGGCAGGATCTCGTTCTGTAGCCAGTTCAGCTGGATCATGCCCGGC
CFTR-C049 AAGATCAAACACAGCGGCAGGATCTCGTTCTGTAGCCAGTTCAGCTGGATCATGCCCGGC
          **.** **.**.  .** * **    **.**.    **.**.   *****.*****.**
```

FIG. 10 (cont)

```
CFTR-WT    ACCATTAAAGAAAATATCATCTTTGGTGTTTCCTATGATGAATATAGATACAGAAGCGTC
CFTR-C001  ACCATCAAGGAGAATATCATCTTCGGGGTGAGCTATGACGAGTACAGGTACCGGAGCGTA
CFTR-C026  ACCATCAAGGAGAATATCATCTTCGGGGTGAGCTATGACGAGTACAGGTACCGGAGCGTA
CFTR-C004  ACGATCAAAGAGAACATCATATTCGGGGTGAGCTACGACGAATACAGGTACCGGAGCGTG
CFTR-C029  ACGATCAAAGAGAACATCATATTCGGGGTGAGCTACGACGAATACAGGTACCGGAGCGTG
CFTR-C021  ACCATAAAGGAGAACATAATCTTCGGCGTCAGCTACGACGAGTACCGATACAGGAGCGTC
CFTR-C046  ACCATAAAGGAGAACATAATCTTCGGCGTCAGCTACGACGAGTACCGATACAGGAGCGTC
CFTR-C008  ACTATCAAGGAAAACATCATCTTCGGCGTGAGCTACGACGAGTACAGGTATCGTAGCGTC
CFTR-C033  ACTATCAAGGAAAACATCATCTTCGGCGTGAGCTACGACGAGTACAGGTATCGTAGCGTC
CFTR-C022  ACGATCAAAGAGAACATCATATTCGGCGTGTCCTACGACGAGTACCGGTACAGGAGCGTG
CFTR-C047  ACGATCAAAGAGAACATCATATTCGGCGTGTCCTACGACGAGTACCGGTACAGGAGCGTG
CFTR-C017  ACCATCAAGGAGAACATCATCTTCGGCGTGAGCTACGACGAGTACAGGTACCGAAGCGTG
CFTR-C042  ACCATCAAGGAGAACATCATCTTCGGCGTGAGCTACGACGAGTACAGGTACCGAAGCGTG
CFTR-C020  ACCATCAAGGAAAACATCATTTTCGGCGTGAGCTACGACGAATACAGATACAGAAGCGTG
CFTR-C045  ACCATCAAGGAAAACATCATTTTCGGCGTGAGCTACGACGAATACAGATACAGAAGCGTG
CFTR-C013  ACCATCAAGGAGAACATCATCTTCGGCGTAAGCTACGATGAGTACCGTTACCGGAGCGTG
CFTR-C038  ACCATCAAGGAGAACATCATCTTCGGCGTAAGCTACGATGAGTACCGTTACCGGAGCGTG
CFTR-C002  ACCATCAAGGAGAACATCATCTTCGGCGTGAGCTACGACGAGTACGGTACAGAAGCGTG
CFTR-C027  ACCATCAAGGAGAACATCATCTTCGGCGTGAGCTACGACGAGTACCGGTACAGAAGCGTG
CFTR-C011  ACCATCAAAGAGAACATCATCTTTGGCGTGTCCTACGACGAGTACCGGTATCGTAGCGTC
CFTR-C036  ACCATCAAAGAGAACATCATCTTTGGCGTGTCCTACGACGAGTACCGGTATCGTAGCGTC
CFTR-C005  ACCATCAAAGAGAACATCATCTTCGGGGTGTCCTACGACGAGTACCGGTACCGCAGCGTG
CFTR-C030  ACCATCAAAGAGAACATCATCTTCGGGGTGTCCTACGACGAGTACCGGTACCGCAGCGTG
CFTR-C006  ACCATCAAAGAGAACATAATCTTTGGTGTGTCCTACGACGAGTACCGGTATAGGAGCGTG
CFTR-C031  ACCATCAAAGAGAACATAATCTTTGGTGTGTCCTACGACGAGTACCGGTATAGGAGCGTG
CFTR-C018  ACCATCAAGGAGAACATAATATTCGGCGTCAGCTATGACGAGTACAGGTACCGTTCCGTG
CFTR-C043  ACCATCAAGGAGAACATAATATTCGGCGTCAGCTATGACGAGTACAGGTACCGTTCCGTG
CFTR-C003  ACCATCAAGGAGAACATTATCTTCGGGGTGAGCTACGACGAATATCGCTACAGGTCCGTG
CFTR-C028  ACCATCAAGGAGAACATTATCTTCGGGGTGAGCTACGACGAATATCGCTACAGGTCCGTG
CFTR-C016  ACCATCAAGGAGAATATCATCTTCGGCGTGAGCTACGACGAGTATCGATACAGGAGCGTG
CFTR-C041  ACCATCAAGGAGAATATCATCTTCGGCGTGAGCTACGACGAGTATCGATACAGGAGCGTG
CFTR-C010  ACAATAAAGGAGAACATCATCTTTGGGGTGAGCTACGACGAGTACCGCTACAGGTCGGTG
CFTR-C035  ACAATAAAGGAGAACATCATCTTTGGGGTGAGCTACGACGAGTACCGCTACAGGTCGGTG
CFTR-C012  ACCATCAAGGAGAACATCATATTTGGGGTGAGCTACGACGAGTACCGGTACAGGTCCGTG
CFTR-C037  ACCATCAAGGAGAACATCATATTTGGGGTGAGCTACGACGAGTACCGGTACAGGTCCGTG
CFTR-C009  ACCATCAAGGAGAACATCATCTTTGGCGTGAGCTACGACGAGTACAGGTATCGGTCTGTC
CFTR-C034  ACCATCAAGGAGAACATCATCTTTGGCGTGAGCTACGACGAGTACAGGTATCGGTCTGTC
CFTR-C015  ACCATCAAGGAGAATATCATCTTCGGTGTGAGCTACGACGAGTACCGGTACAGGTCCGTG
CFTR-C040  ACCATCAAGGAGAATATCATCTTCGGTGTGAGCTACGACGAGTACCGGTACAGGTCCGTG
CFTR-C019  ACCATTAAAGAAAACATCATCTTCGGGGTGAGCTACGACGAATACAGGTACAGGAGCGTG
CFTR-C044  ACCATTAAAGAAAACATCATCTTCGGGGTGAGCTACGACGAATACAGGTACAGGAGCGTG
CFTR-C007  ACAATCAAGGAGAACATTATATTCGGCGTGTCCTACGACGAGTACCGATACCGGAGCGTG
CFTR-C032  ACAATCAAGGAGAACATTATATTCGGCGTGTCCTACGACGAGTACCGATACCGGAGCGTG
CFTR-C014  ACGATCAAGGAAAACATCATCTTCGGCGTCTCCTACGACGAGTACCGGTACCGAAGCGTG
CFTR-C039  ACGATCAAGGAAAACATCATCTTCGGCGTCTCCTACGACGAGTACCGGTACCGAAGCGTG
CFTR-C025  ACCATCAAAGAGAACATCATTTTTGGTGTCTCCTACGATGAGTATCGCTACCGGAGCGTG
CFTR-C050  ACCATCAAAGAGAACATCATTTTTGGTGTCTCCTACGATGAGTATCGCTACCGGAGCGTG
CFTR-C023  ACCATCAAGGAGAACATCATCTTCGGGGTCAGCTACGACGAGTACCGCTATCGCAGCGTG
CFTR-C048  ACCATCAAGGAGAACATCATCTTCGGGGTCAGCTACGACGAGTACCGCTATCGCAGCGTG
CFTR-C024  ACCATTAAAGAGAACATCATCTTCGGCGTGTCCTATGACGAGTACAGGTACAGGAGCGTG
CFTR-C049  ACCATTAAAGAGAACATCATCTTCGGCGTGTCCTATGACGAGTACAGGTACAGGAGCGTG
           ** ** **.**.**.** ** **.** **    ***.**.**.**. * **. *   **
```

FIG. 10 (cont)

```
CFTR-WT    ATCAAAGCATGCCAACTAGAAGAGGACATCTCCAAGTTTGCAGAGAAAGACAATATAGTT
CFTR-C001  ATCAAAGCGTGCCAGCTGGAGGAGGACATCTCCAAGTTTGCCGAGAAGGACAATATCGTG
CFTR-C026  ATCAAAGCGTGCCAGCTGGAGGAGGACATCTCCAAGTTTGCCGAGAAGGACAATATCGTG
CFTR-C004  ATCAAGGCCTGCCAGCTGGAGGAGGACATCTCAAAGTTCGCCGAGAAAGACAACATCGTT
CFTR-C029  ATCAAGGCCTGCCAGCTGGAGGAGGACATCTCAAAGTTCGCCGAGAAAGACAACATCGTT
CFTR-C021  ATCAAAGCCTGCCAGCTCGAGGAGGACATCTCCAAGTTCGCCGAGAAGGATAACATCGTG
CFTR-C046  ATCAAAGCCTGCCAGCTCGAGGAGGACATCTCCAAGTTCGCCGAGAAGGATAACATCGTG
CFTR-C008  ATCAAGGCCTGCCAGCTCGAGGAGGATATCTCCAAGTTCGCCGAGAAGGACAATATCGTC
CFTR-C033  ATCAAGGCCTGCCAGCTCGAGGAGGATATCTCCAAGTTCGCCGAGAAGGACAATATCGTC
CFTR-C022  ATCAAGGCGTGCCAGCTGGAGGAAGACATCAGCAAGTTCGCCGAGAAGGACAACATCGTG
CFTR-C047  ATCAAGGCGTGCCAGCTGGAGGAAGACATCAGCAAGTTCGCCGAGAAGGACAACATCGTG
CFTR-C017  ATCAAGGCCTGCCAGCTGGAGGAGGATATCAGCAAGTTCGCCGAGAAGGACAACATCGTG
CFTR-C042  ATCAAGGCCTGCCAGCTGGAGGAGGATATCAGCAAGTTCGCCGAGAAGGACAACATCGTG
CFTR-C020  ATCAAGGCCTGCCAACTGGAGGAAGACATCAGCAAGTTCGCCGAGAAGGACAATATCGTG
CFTR-C045  ATCAAGGCCTGCCAACTGGAGGAAGACATCAGCAAGTTCGCCGAGAAGGACAATATCGTG
CFTR-C013  ATCAAGGCCTGCCAGCTGGAGGAGGACATCAGCAAGTTTGCCGAGAAGGATAACATCGTG
CFTR-C038  ATCAAGGCCTGCCAGCTGGAGGAGGACATCAGCAAGTTTGCCGAGAAGGATAACATCGTG
CFTR-C002  ATCAAAGCCTGCCAGCTCGAAGAGGACATCAGCAAGTTCGCGGAAAAGGACAATATCGTG
CFTR-C027  ATCAAAGCCTGCCAGCTCGAAGAGGACATCAGCAAGTTCGCGGAAAAGGACAATATCGTG
CFTR-C011  ATCAAGGCCTGTCAGCTGGAGGAGGACATCTCCAAGTTCGCCGAGAAGGACAATATAGTG
CFTR-C036  ATCAAGGCCTGTCAGCTGGAGGAGGACATCTCCAAGTTCGCCGAGAAGGACAATATAGTG
CFTR-C005  ATCAAGGCCTGTCAGCTGGAGGAGGACATCTCCAAGTTTGCCGAGAAGGACAATATCGTG
CFTR-C030  ATCAAGGCCTGTCAGCTGGAGGAGGACATCTCCAAGTTTGCCGAGAAGGACAATATCGTG
CFTR-C006  ATAAAGGCCTGCCAGCTGGAGGAAGATATCAGCAAGTTCGCAGAAAAAGACAACATCGTC
CFTR-C031  ATAAAGGCCTGCCAGCTGGAGGAAGATATCAGCAAGTTCGCAGAAAAAGACAACATCGTC
CFTR-C018  ATTAAGGCCTGCCAGCTGGAGGAGGATATCAGCAAGTTCGCCGAGAAGGACAACATCGTG
CFTR-C043  ATTAAGGCCTGCCAGCTGGAGGAGGATATCAGCAAGTTCGCCGAGAAGGACAACATCGTG
CFTR-C003  ATCAAGGCGTGCCAACTGGAGGAGGACATCTCCAAGTTTGCCGAGAAAGACAACATCGTC
CFTR-C028  ATCAAGGCGTGCCAACTGGAGGAGGACATCTCCAAGTTTGCCGAGAAAGACAACATCGTC
CFTR-C016  ATCAAGGCCTGCCAACTGGAGGAGGATATCTCCAAGTTCGCCGAGAAGGACAACATCGTG
CFTR-C041  ATCAAGGCCTGCCAACTGGAGGAGGATATCTCCAAGTTCGCCGAGAAGGACAACATCGTG
CFTR-C010  ATAAAGGCCTGCCAGCTGGAGGAGGACATCAGCAAGTTCGCCGAAAAGGACAACATCGTG
CFTR-C035  ATAAAGGCCTGCCAGCTGGAGGAGGACATCAGCAAGTTCGCCGAAAAGGACAACATCGTG
CFTR-C012  ATCAAGGCGTGCCAACTGGAAGAGGACATCAGCAAGTTCGCCGAGAAGGACAACATCGTG
CFTR-C037  ATCAAGGCGTGCCAACTGGAAGAGGACATCAGCAAGTTCGCCGAGAAGGACAACATCGTG
CFTR-C009  ATCAAAGCCTGCCAGCTGGAAGAGGATATCAGCAAGTTTGCAGAGAAGGACAACATCGTG
CFTR-C034  ATCAAAGCCTGCCAGCTGGAAGAGGATATCAGCAAGTTTGCAGAGAAGGACAACATCGTG
CFTR-C015  ATCAAGGCCTGCCAGCTCGAGGAGGATATCAGCAAGTTCGCCGAGAAGGACAACATCGTG
CFTR-C040  ATCAAGGCCTGCCAGCTCGAGGAGGATATCAGCAAGTTCGCCGAGAAGGACAACATCGTG
CFTR-C019  ATCAAGGCCTGCCAGCTGGAGGAAGATATCTCCAAATTTGCGGAAAAGGATAACATTGTG
CFTR-C044  ATCAAGGCCTGCCAGCTGGAGGAAGATATCTCCAAATTTGCGGAAAAGGATAACATTGTG
CFTR-C007  ATAAAAGCCTGTCAACTGGAGGAGGATATAAGCAAATTCGCGGAGAAAGACAACATCGTG
CFTR-C032  ATAAAAGCCTGTCAACTGGAGGAGGATATAAGCAAATTCGCGGAGAAAGACAACATCGTG
CFTR-C014  ATTAAGGCCTGCCAGCTGGAAGAGGACATCAGCAAGTTCGCCGAGAAGGACAACATCGTG
CFTR-C039  ATTAAGGCCTGCCAGCTGGAAGAGGACATCAGCAAGTTCGCCGAGAAGGACAACATCGTG
CFTR-C025  ATCAAGGCCTGCCAGCTGGAGGAGGACATCTCGAAGTTTGCCGAAAAGGACAACATTGTC
CFTR-C050  ATCAAGGCCTGCCAGCTGGAGGAGGACATCTCGAAGTTTGCCGAAAAGGACAACATTGTC
CFTR-C023  ATCAAGGCCTGTCAGCTCGAGGAGGACATCAGCAAATTCGCCGAGAAGGACAACATCGTG
CFTR-C048  ATCAAGGCCTGTCAGCTCGAGGAGGACATCAGCAAATTCGCCGAGAAGGACAACATCGTG
CFTR-C024  ATAAAAGCCTGCCAGCTGGAAGAAGACATCTCCAAATTCGCCGAGAAGGACAATATCGTG
CFTR-C049  ATAAAAGCCTGCCAGCTGGAAGAAGACATCTCCAAATTCGCCGAGAAGGACAATATCGTG
           ** **,** **,**,** **,**,**,** **       **,**,** **,**,**,**,** **
```

FIG. 10 (cont)

```
CFTR-WT    CTTGGAGAAGGTGGAATCACACTGAGTGGAGGTCAACGAGCAAGAATTTCTTTAGCAAGA
CFTR-C001  CTGGGCGAGGGTGGCATCACCCTCAGCGGCGGCCAGCGGGCCAGGATCAGCCTGGCCCGG
CFTR-C026  CTGGGCGAGGGTGGCATCACCCTCAGCGGCGGCCAGCGGGCCAGGATCAGCCTGGCCCGG
CFTR-C004  CTGGGGGAGGGCGGGATCACCCTGTCCGGCGGGCAACGGGCCAGGATCAGCCTGGCCCGC
CFTR-C029  CTGGGGGAGGGCGGGATCACCCTGTCCGGCGGGCAACGGGCCAGGATCAGCCTGGCCCGC
CFTR-C021  CTGGGCGAGGGGGGCATCACGCTGTCCGGCGGTCAGAGGGCCAGGATTTCCCTCGCTAGG
CFTR-C046  CTGGGCGAGGGGGGCATCACGCTGTCCGGCGGTCAGAGGGCCAGGATTTCCCTCGCTAGG
CFTR-C008  CTCGGCGAGGGCGGCATCACCCTGAGCGGCGGCCAACGTGCGAGGATTTCACTGGCCCGG
CFTR-C033  CTCGGCGAGGGCGGCATCACCCTGAGCGGCGGCCAACGTGCGAGGATTTCACTGGCCCGG
CFTR-C022  CTCGGCGAGGGCGGAATCACGCTGAGCGGCGGACAGAGGGCCCGCATCAGCCTGGCTAGG
CFTR-C047  CTCGGCGAGGGCGGAATCACGCTGAGCGGCGGACAGAGGGCCCGCATCAGCCTGGCTAGG
CFTR-C017  CTGGGCGAGGGCGGCATCACGCTCAGCGGTGGCCAAAGGGCCCGGATCTCCCTCGCCAGG
CFTR-C042  CTGGGCGAGGGCGGCATCACGCTCAGCGGTGGCCAAAGGGCCCGGATCTCCCTCGCCAGG
CFTR-C020  CTCGGCGAGGGCGGCATCACCCTGAGCGGCGGCCAGAGAGCCCGCATCTCGCTGGCCAGG
CFTR-C045  CTCGGCGAGGGCGGCATCACCCTGAGCGGCGGCCAGAGAGCCCGCATCTCGCTGGCCAGG
CFTR-C013  CTGGGCGAGGGCGGCATCACCCTGAGTGGCGGCCAGAGGGCCAGGATCAGCCTGGCCAGG
CFTR-C038  CTGGGCGAGGGCGGCATCACCCTGAGTGGCGGCCAGAGGGCCAGGATCAGCCTGGCCAGG
CFTR-C002  CTGGGCGAGGGCGGCATCACCCTGAGCGGCGGCCAGCGGGCTCGGATCTCCCTCGCCAGG
CFTR-C027  CTGGGCGAGGGCGGCATCACCCTGAGCGGCGGCCAGCGGGCTCGGATCTCCCTCGCCAGG
CFTR-C011  CTGGGCGAGGGCGGTATCACCCTGAGCGGGGCCAGAGGGCCAGGATCTCCCTGGCCCGG
CFTR-C036  CTGGGCGAGGGCGGTATCACCCTGAGCGGGGCCAGAGGGCCAGGATCTCCCTGGCCCGG
CFTR-C005  CTAGGCGAGGGCGGAATCACGCTGTCCGGCGGCCAGCGGGCCAGGATCAGCCTGGCCAGG
CFTR-C030  CTAGGCGAGGGCGGAATCACGCTGTCCGGCGGCCAGCGGGCCAGGATCAGCCTGGCCAGG
CFTR-C006  CTGGGGGAGGGCGGTATTACCCTGTCCGGCGGCCAACGGGCCCGCATCAGCTTGGCGAGG
CFTR-C031  CTGGGGGAGGGCGGTATTACCCTGTCCGGCGGCCAACGGGCCCGCATCAGCTTGGCGAGG
CFTR-C018  CTTGGCGAGGGAGGGATCACCCTGAGCGGCGGGCAGCGTGCCCGGATATCCCTGGCGAGG
CFTR-C043  CTTGGCGAGGGAGGGATCACCCTGAGCGGCGGGCAGCGTGCCCGGATATCCCTGGCGAGG
CFTR-C003  CTCGGCGAGGGGGGCATCACGTTAAGCGGCGGCCAGAGGGCCAGAATCAGCCTGGCCAGG
CFTR-C028  CTCGGCGAGGGGGGCATCACGTTAAGCGGCGGCCAGAGGGCCAGAATCAGCCTGGCCAGG
CFTR-C016  CTCGGCGAGGGGGGCATAACCCTGAGCGGCGGCCAGAGGGCGCGGATCAGCCTGGCCAGG
CFTR-C041  CTCGGCGAGGGGGGCATAACCCTGAGCGGCGGCCAGAGGGCGCGGATCAGCCTGGCCAGG
CFTR-C010  CTGGGGGAGGGTGGCATAACCCTCAGCGGCGGGCAGAGGGCGAGGATCAGCCTGGCCAGG
CFTR-C035  CTGGGGGAGGGTGGCATAACCCTCAGCGGCGGGCAGAGGGCGAGGATCAGCCTGGCCAGG
CFTR-C012  CTGGGAGAGGGTGGAATCACCCTGAGCGGTGGGCAGCGGGCCAGGATAAGCCTCGCCAGG
CFTR-C037  CTGGGAGAGGGTGGAATCACCCTGAGCGGTGGGCAGCGGGCCAGGATAAGCCTCGCCAGG
CFTR-C009  CTGGGGGAAGGCGGCATCACCCTGAGCGGCGGGCAGCGCGCCAGGATCTCCCTGGCCCGT
CFTR-C034  CTGGGGGAAGGCGGCATCACCCTGAGCGGCGGGCAGCGCGCCAGGATCTCCCTGGCCCGT
CFTR-C015  CTCGGGGAGGGCGGTATAACCCTGAGCGGCGGGCAGCGGGCCAGGATCAGCCTGGCCAGG
CFTR-C040  CTCGGGGAGGGCGGTATAACCCTGAGCGGCGGGCAGCGGGCCAGGATCAGCCTGGCCAGG
CFTR-C019  CTGGGCGAAGGCGGGATCACTCTCAGCGGTGGTCAGCGCGCCCGGATAAGCCTGGCGCGC
CFTR-C044  CTGGGCGAAGGCGGGATCACTCTCAGCGGTGGTCAGCGCGCCCGGATAAGCCTGGCGCGC
CFTR-C007  CTGGGCGAAGGGGGTATCACCCTGTCCGGCGGCCAACGTGCGAGGATCAGCCTGGCCCGG
CFTR-C032  CTGGGCGAAGGGGGTATCACCCTGTCCGGCGGCCAACGTGCGAGGATCAGCCTGGCCCGG
CFTR-C014  CTGGGCGAGGGCGGCATCACACTGAGCGGCGGCCAGAGGGCAAGGATCAGCCTGGCTCGG
CFTR-C039  CTGGGCGAGGGCGGCATCACACTGAGCGGCGGCCAGAGGGCAAGGATCAGCCTGGCTCGG
CFTR-C025  CTGGGTGAAGGAGGGATTACCCTGAGCGGGGGCCAGAGGGCCCGGATCAGCCTGGCCCGC
CFTR-C050  CTGGGTGAAGGAGGGATTACCCTGAGCGGGGGCCAGAGGGCCCGGATCAGCCTGGCCCGC
CFTR-C023  CTCGGCGAGGGCGGGATCACCCTCAGCGGCGGGCAACGGGCCCGGATCAGCCTCGCCAGG
CFTR-C048  CTCGGCGAGGGCGGGATCACCCTCAGCGGCGGGCAACGGGCCCGGATCAGCCTCGCCAGG
CFTR-C024  CTCGGTGAGGGCGGCATCACGCTGAGCGGAGGCCAGAGGGCCCGGATCTCGCTCGCCAGG
CFTR-C049  CTCGGTGAGGGCGGCATCACGCTGAGCGGAGGCCAGAGGGCCCGGATCTCGCTCGCCAGG
           ** ** ** ** ** ** **  *   ** ** **  * **  * **      * **  *
```

FIG. 10 (cont)

```
CFTR-WT   GCAGTATACAAAGATGCTGATTTGTATTTATTAGACTCTCCTTTTGGATACCTAGATGTT
CFTR-C001 GCCGTGTACAAGGACGCTGATCTCTACCTGCTGGACAGCCCATTCGGCTACCTGGACGTG
CFTR-C026 GCCGTGTACAAGGACGCTGATCTCTACCTGCTGGACAGCCCATTCGGCTACCTGGACGTG
CFTR-C004 GCGGTCTACAAGGACGCCGACCTGTACCTGCTCGATAGCCCGTTCGGTTACCTGGATGTC
CFTR-C029 GCGGTCTACAAGGACGCCGACCTGTACCTGCTCGATAGCCCGTTCGGTTACCTGGATGTC
CFTR-C021 GCCGTGTATAAGGATGCCGACCTCTATCTGCTGGACAGCCCCTTTGGTTACCTGGACGTG
CFTR-C046 GCCGTGTATAAGGATGCCGACCTCTATCTGCTGGACAGCCCCTTTGGTTACCTGGACGTG
CFTR-C008 GCCGTGTACAAGGACGCGGACCTGTACCTCCTGGACTCCCCGTCGGCTACCTGGACGTG
CFTR-C033 GCCGTGTACAAGGACGCGGACCTGTACCTCCTGGACTCCCCGTCGGCTACCTGGACGTG
CFTR-C022 GCCGTGTACAAAGACGCCGACCTGTACCTGCTGGACAGCCCCTTCGGTTACCTCGACGTG
CFTR-C047 GCCGTGTACAAAGACGCCGACCTGTACCTGCTGGACAGCCCCTTCGGTTACCTCGACGTG
CFTR-C017 GCCGTGTACAAGGACGCCGACCTGTACCTGCTCGACAGCCCCTTCGGGTACCTCGATGTG
CFTR-C042 GCCGTGTACAAGGACGCCGACCTGTACCTGCTCGACAGCCCCTTCGGGTACCTCGATGTG
CFTR-C020 GCCGTCTACAAGGACGCCGATCTGTATCTGCTGGACAGCCCCTTCGGCTACCTGGACGTG
CFTR-C045 GCCGTCTACAAGGACGCCGATCTGTATCTGCTGGACAGCCCCTTCGGCTACCTGGACGTG
CFTR-C013 GCCGTGTATAAGGATGCCGACCTCTACCTGCTGGACTCCCCCTTCGGATACCTGGACGTG
CFTR-C038 GCCGTGTATAAGGATGCCGACCTCTACCTGCTGGACTCCCCCTTCGGATACCTGGACGTG
CFTR-C002 GCCGTGTACAAGGACGCCGACCTCTATCTGCTGGACAGCCCCTTCGGTTACCTGGATGTC
CFTR-C027 GCCGTGTACAAGGACGCCGACCTCTATCTGCTGGACAGCCCCTTCGGTTACCTGGATGTC
CFTR-C011 GCCGTGTACAAAGACGCCGATCTGTACCTGCTGGACAGCCCCTTCGGCTACCTGGACGTG
CFTR-C036 GCCGTGTACAAAGACGCCGATCTGTACCTGCTGGACAGCCCCTTCGGCTACCTGGACGTG
CFTR-C005 GCCGTCTATAAGGACGCCGACCTGTACCTGCTGGACAGCCCCTTCGGGTACCTCGACGTG
CFTR-C030 GCCGTCTATAAGGACGCCGACCTGTACCTGCTGGACAGCCCCTTCGGGTACCTCGACGTG
CFTR-C006 GCCGTGTATAAAGACGCCGATCTGTACCTGCTGGACAGCCCGTCGGATACCTGGATGTG
CFTR-C031 GCCGTGTATAAAGACGCCGATCTGTACCTGCTGGACAGCCCGTCGGATACCTGGATGTG
CFTR-C018 GCCGTGTACAAGGACGCCGATCTCTACCTGCTGGATAGTCCCTTCGGGTACCTGGACGTG
CFTR-C043 GCCGTGTACAAGGACGCCGATCTCTACCTGCTGGATAGTCCCTTCGGGTACCTGGACGTG
CFTR-C003 GCGGTGTACAAGGATGCCGACCTCTACCTGCTGGACAGCCCCTTTGGCTACCTGGACGTG
CFTR-C028 GCGGTGTACAAGGATGCCGACCTCTACCTGCTGGACAGCCCCTTTGGCTACCTGGACGTG
CFTR-C016 GCCGTGTACAAGGACGCCGACCTGTACTTGCTGGACAGCCCGTTTGGGTACCTCGACGTG
CFTR-C041 GCCGTGTACAAGGACGCCGACCTGTACTTGCTGGACAGCCCGTTTGGGTACCTCGACGTG
CFTR-C010 GCCGTGTACAAGGACGCCGACCTGTACCTGCTGGACTCCCCCTTCGGCTACCTAGATGTG
CFTR-C035 GCCGTGTACAAGGACGCCGACCTGTACCTGCTGGACTCCCCCTTCGGCTACCTAGATGTG
CFTR-C012 GCCGTGTACAAAGATGCCGACCTGTACCTGCTGGACTCCCCGTTCGGCTATCTGGACGTG
CFTR-C037 GCCGTGTACAAAGATGCCGACCTGTACCTGCTGGACTCCCCGTTCGGCTATCTGGACGTG
CFTR-C009 GCCGTGTACAAGGACGCCGACCTGTACTTACTGGACAGCCCCTTCGGCTATCTGGACGTG
CFTR-C034 GCCGTGTACAAGGACGCCGACCTGTACTTACTGGACAGCCCCTTCGGCTATCTGGACGTG
CFTR-C015 GCCGTGTACAAGGACGCGGATCTGTACCTGCTGGACAGCCCGTTCGGGTACCTGGACGTG
CFTR-C040 GCCGTGTACAAGGACGCGGATCTGTACCTGCTGGACAGCCCGTTCGGGTACCTGGACGTG
CFTR-C019 GCCGTGTACAAGGACGCCGACCTGTATCTGCTGGACTCCCCCTTCGGCTACCTGGACGTG
CFTR-C044 GCCGTGTACAAGGACGCCGACCTGTATCTGCTGGACTCCCCCTTCGGCTACCTGGACGTG
CFTR-C007 GCCGTGTACAAAGACGCCGACCTATACCTCCTCGACAGCCCCTTCGGCTACCTGGACGTG
CFTR-C032 GCCGTGTACAAAGACGCCGACCTATACCTCCTCGACAGCCCCTTCGGCTACCTGGACGTG
CFTR-C014 GCCGTGTATAAGGACGCCGACCTGTACCTTCTGGACAGCCCCTTTGGATACCTGGATGTG
CFTR-C039 GCCGTGTATAAGGACGCCGACCTGTACCTTCTGGACAGCCCCTTTGGATACCTGGATGTG
CFTR-C025 GCCGTCTACAAGGACGCCGACCTGTACCTGCTGGACAGCCCCTTCGGATACCTGGACGTG
CFTR-C050 GCCGTCTACAAGGACGCCGACCTGTACCTGCTGGACAGCCCCTTCGGATACCTGGACGTG
CFTR-C023 GCCGTGTACAAGGATGCGGACCTGTACCTGCTGGACAGCCCCTTCGGCTACCTGGACGTG
CFTR-C048 GCCGTGTACAAGGATGCGGACCTGTACCTGCTGGACAGCCCCTTCGGCTACCTGGACGTG
CFTR-C024 GCCGTGTATAAGGACGCGGACCTGTATCTGCTGGACAGCCCCTTTGGCTACCTGGACGTG
CFTR-C049 GCCGTGTATAAGGACGCGGACCTGTATCTGCTGGACAGCCCCTTTGGCTACCTGGACGTG
          ** ** ** **.**.** **..* **..* ,* **,   ,**.**.**.**.**,**
```

FIG. 10 (cont)

| | |
|---|---|
| CFTR-WT | TTAACAGAAAAAGAAATATTTGAAAGCTGTGTCTGTAAACTGATGGCTAACAAAACTAGG |
| CFTR-C001 | CTGACCGAGAAGGAAATTTTCGAGTCCTGCGTGTGCAAGCTGATGGCCAACAAAACCAGG |
| CFTR-C026 | CTGACCGAGAAGGAAATTTTCGAGTCCTGCGTGTGCAAGCTGATGGCCAACAAAACCAGG |
| CFTR-C004 | CTGACCGAGAAGGAGATCTTCGAGAGCTGCGTGTGCAAGCTGATGGCCAACAAGACCAGG |
| CFTR-C029 | CTGACCGAGAAGGAGATCTTCGAGAGCTGCGTGTGCAAGCTGATGGCCAACAAGACCAGG |
| CFTR-C021 | CTGACCGAAAAGGAAATTTTCGAGAGCTGCGTGTGCAAGCTGATGGCCAACAAGACGCGC |
| CFTR-C046 | CTGACCGAAAAGGAAATTTTCGAGAGCTGCGTGTGCAAGCTGATGGCCAACAAGACGCGC |
| CFTR-C008 | CTCACCGAGAAGGAGATCTTCGAGAGCTGCGTGTGCAAGCTGATGGCCAACAAGACCAGG |
| CFTR-C033 | CTCACCGAGAAGGAGATCTTCGAGAGCTGCGTGTGCAAGCTGATGGCCAACAAGACCAGG |
| CFTR-C022 | CTGACGGAGAAGGAGATCTTCGAGTCCTGTGTCTGCAAGCTGATGGCCAATAAGACCAGG |
| CFTR-C047 | CTGACGGAGAAGGAGATCTTCGAGTCCTGTGTCTGCAAGCTGATGGCCAATAAGACCAGG |
| CFTR-C017 | CTGACCGAAAAGGAGATCTTCGAGTCCTGCGTGTGCAAGCTGATGGCGAACAAGACCCGG |
| CFTR-C042 | CTGACCGAAAAGGAGATCTTCGAGTCCTGCGTGTGCAAGCTGATGGCGAACAAGACCCGG |
| CFTR-C020 | CTGACCGAAAAGGAGATCTTCGAGAGCTGCGTGTGTAAACTGATGGCCAACAAAACCCGG |
| CFTR-C045 | CTGACCGAAAAGGAGATCTTCGAGAGCTGCGTGTGTAAACTGATGGCCAACAAAACCCGG |
| CFTR-C013 | CTGACCGAAAAAGAGATCTTCGAGAGCTGCGTGTGCAAGCTCATGGCCAACAAGACCAGG |
| CFTR-C038 | CTGACCGAAAAAGAGATCTTCGAGAGCTGCGTGTGCAAGCTCATGGCCAACAAGACCAGG |
| CFTR-C002 | CTGACCGAGAAGGAAATCTTCGAGAGCTGCGTGTGTAAGCTGATGGCCAACAAGACTCGC |
| CFTR-C027 | CTGACCGAGAAGGAAATCTTCGAGAGCTGCGTGTGTAAGCTGATGGCCAACAAGACTCGC |
| CFTR-C011 | CTGACCGAGAAGGAGATCTTTGAAAGCTGCGTATGCAAACTGATGGCCAACAAAACCCGT |
| CFTR-C036 | CTGACCGAGAAGGAGATCTTTGAAAGCTGCGTATGCAAACTGATGGCCAACAAAACCCGT |
| CFTR-C005 | CTGACCGAGAAGGAGATCTTCGAGTCGTGCGTGTGCAAACTGATGGCCAACAAGACCAGG |
| CFTR-C030 | CTGACCGAGAAGGAGATCTTCGAGTCGTGCGTGTGCAAACTGATGGCCAACAAGACCAGG |
| CFTR-C006 | CTGACCGAGAAGGAGATCTTCGAGAGCTGTGTGTGCAAGCTGATGGCCAACAAGACCCGC |
| CFTR-C031 | CTGACCGAGAAGGAGATCTTCGAGAGCTGTGTGTGCAAGCTGATGGCCAACAAGACCCGC |
| CFTR-C018 | CTGACCGAGAAAGAGATCTTCGAGTCCTGCGTGTGTAAACTGATGGCCAATAAGACCAGG |
| CFTR-C043 | CTGACCGAGAAAGAGATCTTCGAGTCCTGCGTGTGTAAACTGATGGCCAATAAGACCAGG |
| CFTR-C003 | CTCACGGAGAAGGAGATCTTCGAGAGCTGCGTGTGTAAGCTGATGGCCAACAAAACGCGC |
| CFTR-C028 | CTCACGGAGAAGGAGATCTTCGAGAGCTGCGTGTGTAAGCTGATGGCCAACAAAACGCGC |
| CFTR-C016 | CTGACCGAGAAGGAGATCTTCGAGAGCTGCGTGTGTAAGCTGATGGCCAACAAGACCAGG |
| CFTR-C041 | CTGACCGAGAAGGAGATCTTCGAGAGCTGCGTGTGTAAGCTGATGGCCAACAAGACCAGG |
| CFTR-C010 | TTAACGGAGAAGGAGATCTTCGAGTCCTGTGTGTGCAAGCTGATGGCCAACAAGACCCGC |
| CFTR-C035 | TTAACGGAGAAGGAGATCTTCGAGTCCTGTGTGTGCAAGCTGATGGCCAACAAGACCCGC |
| CFTR-C012 | CTGACCGAAAAGGAGATCTTCGAGTCCTGCGTGTGTAAGCTCATGGCGAACAAGACCCGG |
| CFTR-C037 | CTGACCGAAAAGGAGATCTTCGAGTCCTGCGTGTGTAAGCTCATGGCGAACAAGACCCGG |
| CFTR-C009 | CTAACCGAGAAGGAAATCTTCGAGTCCTGCGTGTGTAAGCTGATGGCCAACAAGACCCGC |
| CFTR-C034 | CTAACCGAGAAGGAAATCTTCGAGTCCTGCGTGTGTAAGCTGATGGCCAACAAGACCCGC |
| CFTR-C015 | CTGACCGAGAAGGAGATCTTCGAGAGCTGCGTCTGCAAGCTGATGGCCAACAAAACCCGG |
| CFTR-C040 | CTGACCGAGAAGGAGATCTTCGAGAGCTGCGTCTGCAAGCTGATGGCCAACAAAACCCGG |
| CFTR-C019 | CTCACCGAGAAGGAGATCTTCGAGTCCTGCGTGTGCAAACTCATGGCCAACAAGACCAGG |
| CFTR-C044 | CTCACCGAGAAGGAGATCTTCGAGTCCTGCGTGTGCAAACTCATGGCCAACAAGACCAGG |
| CFTR-C007 | CTGACGGAGAAGGAGATCTTCGAGAGCTGCGTCTGCAAGCTGATGGCCAACAAAACTCGG |
| CFTR-C032 | CTGACGGAGAAGGAGATCTTCGAGAGCTGCGTCTGCAAGCTGATGGCCAACAAAACTCGG |
| CFTR-C014 | CTGACCGAGAAGGAGATCTTCGAGAGCTGTGTGTGCAAACTGATGGCCAATAAGACCCGT |
| CFTR-C039 | CTGACCGAGAAGGAGATCTTCGAGAGCTGTGTGTGCAAACTGATGGCCAATAAGACCCGT |
| CFTR-C025 | CTGACCGAGAAGGAGATCTTCGAGAGCTGCGTCTGCAAGCTGATGGCCAACAAGACCAGG |
| CFTR-C050 | CTGACCGAGAAGGAGATCTTCGAGAGCTGCGTCTGCAAGCTGATGGCCAACAAGACCAGG |
| CFTR-C023 | CTCACCGAGAAGGAGATCTTCGAGTCCTGCGTGTGTAAGCTCATGGCGAACAAGACCAGG |
| CFTR-C048 | CTCACCGAGAAGGAGATCTTCGAGTCCTGCGTGTGTAAGCTCATGGCGAACAAGACCAGG |
| CFTR-C024 | CTGACCGAGAAAGAGATCTTTGAGAGCTGCGTCTGCAAGCTCATGGCCAACAAGACCAGA |
| CFTR-C049 | CTGACCGAGAAAGAGATCTTTGAGAGCTGCGTCTGCAAGCTCATGGCCAACAAGACCAGA |
| | .*  ... ., . .. *** .. * |

FIG. 10 (cont)

```
CFTR-WT    ATTTTGGTCACTTCTAAAATGGAACATTTAAAGAAAGCTGACAAAATATTAATTTTGCAT
CFTR-C001  ATCCTGGTGACCAGCAAAATGGAGCATCTGAAGAAGGCCGACAAGATCCTCATCCTGCAT
CFTR-C026  ATCCTGGTGACCAGCAAAATGGAGCATCTGAAGAAGGCCGACAAGATCCTCATCCTGCAT
CFTR-C004  ATCCTGGTGACCAGTAAAATGGAGCACCTGAAGAAAGCCGACAAGATCCTGATCCTGCAC
CFTR-C029  ATCCTGGTGACCAGTAAAATGGAGCACCTGAAGAAAGCCGACAAGATCCTGATCCTGCAC
CFTR-C021  ATACTGGTCACCAGCAAGATGGAGCATCTGAAGAAGGCCGACAAGATCCTGATCCTGCAC
CFTR-C046  ATACTGGTCACCAGCAAGATGGAGCATCTGAAGAAGGCCGACAAGATCCTGATCCTGCAC
CFTR-C008  ATCCTGGTGACAAGCAAGATGGAGCACCTCAAGAAAGCCGATAAGATCCTGATCCTACAT
CFTR-C033  ATCCTGGTGACAAGCAAGATGGAGCACCTCAAGAAAGCCGATAAGATCCTGATCCTACAT
CFTR-C022  ATCCTGGTGACCAGCAAGATGGAGCACCTGAAGAAGGCCGACAAGATACTGATCCTCCAC
CFTR-C047  ATCCTGGTGACCAGCAAGATGGAGCACCTGAAGAAGGCCGACAAGATACTGATCCTCCAC
CFTR-C017  ATTCTCGTGACCAGCAAAATGGAGCATCTCAAGAAGGCCGACAAGATCCTGATCCTGCAC
CFTR-C042  ATTCTCGTGACCAGCAAAATGGAGCATCTCAAGAAGGCCGACAAGATCCTGATCCTGCAC
CFTR-C020  ATCCTGGTGACGAGCAAGATGGAGCATCTGAAGAAGGCCGACAAAATCCTGATACTGCAC
CFTR-C045  ATCCTGGTGACGAGCAAGATGGAGCATCTGAAGAAGGCCGACAAAATCCTGATACTGCAC
CFTR-C013  ATCCTCGTCACCAGCAAAATGGAGCACCTGAAGAAGGCCGATAAGATACTGATCCTGCAC
CFTR-C038  ATCCTCGTCACCAGCAAAATGGAGCACCTGAAGAAGGCCGATAAGATACTGATCCTGCAC
CFTR-C002  ATACTGGTGACCAGCAAGATGGAGCACCTGAAGAAGGCGGACAAGATCCTGATCCTGCAC
CFTR-C027  ATACTGGTGACCAGCAAGATGGAGCACCTGAAGAAGGCGGACAAGATCCTGATCCTGCAC
CFTR-C011  ATCCTGGTGACCAGCAAGATGGAGCACCTCAAGAAGGCCGATAAGATCCTGATCCTGCAT
CFTR-C036  ATCCTGGTGACCAGCAAGATGGAGCACCTCAAGAAGGCCGATAAGATCCTGATCCTGCAT
CFTR-C005  ATCCTGGTGACCTCCAAGATGGAGCACCTGAAGAAGGCTGACAAGATCCTGATCCTACAT
CFTR-C030  ATCCTGGTGACCTCCAAGATGGAGCACCTGAAGAAGGCTGACAAGATCCTGATCCTACAT
CFTR-C006  ATCCTGGTGACCAGCAAAATGGAGCACCTCAAGAAAGCCGACAAAATCCTCATCCTGCAC
CFTR-C031  ATCCTGGTGACCAGCAAAATGGAGCACCTCAAGAAAGCCGACAAAATCCTCATCCTGCAC
CFTR-C018  ATCCTGGTCACCAGCAAGATGGAGCATCTGAAGAAGGCCGATAAAATCCTGATCCTGCAC
CFTR-C043  ATCCTGGTCACCAGCAAGATGGAGCATCTGAAGAAGGCCGATAAAATCCTGATCCTGCAC
CFTR-C003  ATCCTGGTGACCTCGAAGATGGAACACCTGAAGAAGGCCGACAAGATCCTGATACTGCAC
CFTR-C028  ATCCTGGTGACCTCGAAGATGGAACACCTGAAGAAGGCCGACAAGATCCTGATACTGCAC
CFTR-C016  ATCCTGGTGACGAGCAAAATGGAGCATCTGAAGAAGGCCGACAAAATTCTGATACTGCAT
CFTR-C041  ATCCTGGTGACGAGCAAAATGGAGCATCTGAAGAAGGCCGACAAAATTCTGATACTGCAT
CFTR-C010  ATCCTCGTGACCAGCAAAATGGAACACCTCAAGAAGGCAGACAAGATCCTGATCCTGCAC
CFTR-C035  ATCCTCGTGACCAGCAAAATGGAACACCTCAAGAAGGCAGACAAGATCCTGATCCTGCAC
CFTR-C012  ATCCTGGTCACCTCCAAGATGGAGCACCTGAAGAAGGCGGACAAGATACTCATACTGCAC
CFTR-C037  ATCCTGGTCACCTCCAAGATGGAGCACCTGAAGAAGGCGGACAAGATACTCATACTGCAC
CFTR-C009  ATCCTGGTGACCTCCAAGATGGAGCACCTCAAGAAGGCCGATAAGATCCTGATCCTGCAC
CFTR-C034  ATCCTGGTGACCTCCAAGATGGAGCACCTCAAGAAGGCCGATAAGATCCTGATCCTGCAC
CFTR-C015  ATCCTCGTCACCAGCAAAATGGAACACCTGAAAAAGGCCGACAAAATCCTGATCCTGCAC
CFTR-C040  ATCCTCGTCACCAGCAAAATGGAACACCTGAAAAAGGCCGACAAAATCCTGATCCTGCAC
CFTR-C019  ATCCTCGTCACGAGCAAGATGGAGCACCTGAAAAAGGCCGACAAGATCCTGATCCTGCAT
CFTR-C044  ATCCTCGTCACGAGCAAGATGGAGCACCTGAAAAAGGCCGACAAGATCCTGATCCTGCAT
CFTR-C007  ATCCTGGTGACCAGCAAGATGGAGCACCTGAAGAAGGCCGACAAAATTCTGATCCTGCAC
CFTR-C032  ATCCTGGTGACCAGCAAGATGGAGCACCTGAAGAAGGCCGACAAAATTCTGATCCTGCAC
CFTR-C014  ATCCTGGTGACCAGCAAGATGGAGCATCTCAAGAAAGCCGATAAGATCCTGATCCTGCAC
CFTR-C039  ATCCTGGTGACCAGCAAGATGGAGCATCTCAAGAAAGCCGATAAGATCCTGATCCTGCAC
CFTR-C025  ATCCTGGTGACCAGCAAAATGGAACACCTCAAGAAAGCGGACAAGATCCTGATACTGCAC
CFTR-C050  ATCCTGGTGACCAGCAAAATGGAACACCTCAAGAAAGCGGACAAGATCCTGATACTGCAC
CFTR-C023  ATCCTCGTGACCAGCAAGATGGAGCATCTGAAAAAGGCGGACAAAATCCTTATCCTGCAC
CFTR-C048  ATCCTCGTGACCAGCAAGATGGAGCATCTGAAAAAGGCGGACAAAATCCTTATCCTGCAC
CFTR-C024  ATCCTGGTGACCAGCAAGATGGAACATCTGAAGAAGGCCGACAAGATTCTCATCCTGCAC
CFTR-C049  ATCCTGGTGACCAGCAAGATGGAACATCTGAAGAAGGCCGACAAGATTCTCATCCTGCAC
           **  * ** **    **,*****,**,,* **,**,** **,**,** ,* ** ,* **,
```

FIG. 10 (cont)

```
CFTR-WT   GAAGGTAGCAGCTATTTTTATGGGACATTTTCAGAACTCCAAAATCTACAGCCAGACTTT
CFTR-C001 GAAGGCAGCTCCTACTTCTACGGTACCTTCTCCGAGCTCCAGAACCTCCAGCCCGACTTT
CFTR-C026 GAAGGCAGCTCCTACTTCTACGGTACCTTCTCCGAGCTCCAGAACCTCCAGCCCGACTTT
CFTR-C004 GAGGGGAGCAGCTACTTCTACGGCACCTTCAGCGAGCTGCAGAACCTGCAGCCAGACTTT
CFTR-C029 GAGGGGAGCAGCTACTTCTACGGCACCTTCAGCGAGCTGCAGAACCTGCAGCCAGACTTT
CFTR-C021 GAGGGCAGCAGCTACTTCTACGGGACATTCAGCGAGCTGCAGAACCTACAGCCCGACTTC
CFTR-C046 GAGGGCAGCAGCTACTTCTACGGGACATTCAGCGAGCTGCAGAACCTACAGCCCGACTTC
CFTR-C008 GAGGGCAGCTCGTATTTCTACGGGACTTTCAGCGAGCTGCAGAACCTCCAACCCGACTTT
CFTR-C033 GAGGGCAGCTCGTATTTCTACGGGACTTTCAGCGAGCTGCAGAACCTCCAACCCGACTTT
CFTR-C022 GAGGGCTCCTCGTACTTCTACGGCACCTTCTCCGAGCTGCAGAACCTGCAGCCCGATTTC
CFTR-C047 GAGGGCTCCTCGTACTTCTACGGCACCTTCTCCGAGCTGCAGAACCTGCAGCCCGATTTC
CFTR-C017 GAAGGCAGCAGCTATTTCTACGGCACCTTCAGCGAGCTCCAGAACCTGCAGCCCGACTTC
CFTR-C042 GAAGGCAGCAGCTATTTCTACGGCACCTTCAGCGAGCTCCAGAACCTGCAGCCCGACTTC
CFTR-C020 GAGGGGAGCAGCTACTTCTACGGCACCTTCAGCGAGCTGCAGAATCTGCAGCCCGACTTT
CFTR-C045 GAGGGGAGCAGCTACTTCTACGGCACCTTCAGCGAGCTGCAGAATCTGCAGCCCGACTTT
CFTR-C013 GAGGGGAGCTCCTACTTCTACGGCACCTTCAGCGAACTGCAGAACCTGCAGCCCGACTTC
CFTR-C038 GAGGGGAGCTCCTACTTCTACGGCACCTTCAGCGAACTGCAGAACCTGCAGCCCGACTTC
CFTR-C002 GAGGGCAGCAGCTACTTCTACGGCACCTTCAGCGAACTGCAGAATCTGCAGCCCGACTTC
CFTR-C027 GAGGGCAGCAGCTACTTCTACGGCACCTTCAGCGAACTGCAGAATCTGCAGCCCGACTTC
CFTR-C011 GAGGGCAGCTCCTATTTCTACGGCACCTTTAGCGAGCTGCAGAACCTGCAGCCCGATTTC
CFTR-C036 GAGGGCAGCTCCTATTTCTACGGCACCTTTAGCGAGCTGCAGAACCTGCAGCCCGATTTC
CFTR-C005 GAAGGCTCCAGCTACTTTTACGGGACCTTCAGCGAACTGCAGAACCTGCAACCCGACTTC
CFTR-C030 GAAGGCTCCAGCTACTTTTACGGGACCTTCAGCGAACTGCAGAACCTGCAACCCGACTTC
CFTR-C006 GAGGGGAGCAGCTATTTCTACGGCACCTTCTCCGAACTGCAGAACCTGCAGCCCGACTTC
CFTR-C031 GAGGGGAGCAGCTATTTCTACGGCACCTTCTCCGAACTGCAGAACCTGCAGCCCGACTTC
CFTR-C018 GAGGGCAGCAGCTACTTCTACGGGACCTTTTCCGAGCTCCAGAACCTGCAGCCCGACTTC
CFTR-C043 GAGGGCAGCAGCTACTTCTACGGGACCTTTTCCGAGCTCCAGAACCTGCAGCCCGACTTC
CFTR-C003 GAGGGAAGCTCCTATTTTTACGGCACTTTTAGCGAGCTCCAGAACCTGCAGCCCGACTTC
CFTR-C028 GAGGGAAGCTCCTATTTTTACGGCACTTTTAGCGAGCTCCAGAACCTGCAGCCCGACTTC
CFTR-C016 GAGGGCAGCAGCTATTTCTACGGAACCTTCAGCGAGCTTCAGAACCTGCAGCCCGACTTC
CFTR-C041 GAGGGCAGCAGCTATTTCTACGGAACCTTCAGCGAGCTTCAGAACCTGCAGCCCGACTTC
CFTR-C010 GAGGGTTCCAGCTACTTCTACGGCACGTTCAGCGAGCTGCAGAATCTGCAGCCCGAGTTC
CFTR-C035 GAGGGTTCCAGCTACTTCTACGGCACGTTCAGCGAGCTGCAGAATCTGCAGCCCGACTTC
CFTR-C012 GAGGGGAGCTCATACTTCTACGGAACCTTTAGCGAGCTGCAGAACCTCCAGCCCGACTTC
CFTR-C037 GAGGGGAGCTCATACTTCTACGGAACCTTTAGCGAGCTGCAGAACCTCCAGCCCGACTTC
CFTR-C009 GAGGGCTCCAGCTACTTCTACGGCACCTTCAGCGAGCTGCAAAACCTCCAACCCGACTTC
CFTR-C034 GAGGGCTCCAGCTACTTCTACGGCACCTTCAGCGAGCTGCAAAACCTCCAACCCGACTTC
CFTR-C015 GAAGGCTCGTCCTACTTCTACGGCACCTTCAGCGAACTGCAGAACCTCCAACCCGACTTT
CFTR-C040 GAAGGCTCGTCCTACTTCTACGGCACCTTCAGCGAACTGCAGAACCTCCAACCCGACTTT
CFTR-C019 GAGGGCAGCAGCTACTTCTATGGCACCTTCAGCGAGCTGCAGAACCTGCAGCCCGACTTC
CFTR-C044 GAGGGCAGCAGCTACTTCTATGGCACCTTCAGCGAGCTGCAGAACCTGCAGCCCGACTTC
CFTR-C007 GAAGGGTCCAGCTACTTCTACGGGACGTTCTCCGAGCTCCAGAACCTCCAGCCCGACTTC
CFTR-C032 GAAGGGTCCAGCTACTTCTACGGGACGTTCTCCGAGCTCCAGAACCTCCAGCCCGACTTC
CFTR-C014 GAAGGCTCCAGCTACTTCTACGGCACCTTTTCCGAGCTGCAGAACCTGCAGCCCGATTTC
CFTR-C039 GAAGGCTCCAGCTACTTCTACGGCACCTTTTCCGAGCTGCAGAACCTGCAGCCCGATTTC
CFTR-C025 GAGGGCAGCTCGTACTTCTACGGCACCTTCAGCGAGCTGCAGAACCTGCAGCCCGACTTC
CFTR-C050 GAGGGCAGCTCGTACTTCTACGGCACCTTCAGCGAGCTGCAGAACCTGCAGCCCGACTTC
CFTR-C023 GAGGGTCCTCCTATTTCTATGGCACCTTCTCCGAGCTCCAGAACCTGCAGCCGGACTTC
CFTR-C048 GAGGGTCCTCCTATTTCTATGGCACCTTCTCCGAGCTCCAGAACCTGCAGCCGGACTTC
CFTR-C024 GAGGGTCCAGCTACTTCTATGGGACCTTCTCCGAGCTGCAGAACCTGCAACCCGACTTC
CFTR-C049 GAGGGTCCAGCTACTTCTATGGGACCTTCTCCGAGCTGCAGAACCTGCAACCCGACTTC
          **.**      **.**.** ** **.   **.** **.**.** **.** **.**.
```

FIG. 10 (cont)

```
CFTR-WT    AGCTCAAAACTCATGGGATGTGATTCTTTCGACCAATTTAGTGCAGAAAGAAGAAATTCA
CFTR-C001  AGCAGCAAGCTCATGGGCTGCGACAGCTTCGATCAGTTCAGCGCCGAGAGGAGGAACTCC
CFTR-C026  AGCAGCAAGCTCATGGGCTGCGACAGCTTCGATCAGTTCAGCGCCGAGAGGAGGAACTCC
CFTR-C004  TCGAGCAAGCTCATGGGCTGCGATAGCTTCGACCAGTTCAGCGCCGAGAGGAGGAACTCC
CFTR-C029  TCGAGCAAGCTCATGGGCTGCGATAGCTTCGACCAGTTCAGCGCCGAGAGGAGGAACTCC
CFTR-C021  AGCTCGAAGCTGATGGGGTGCGACAGCTTCGATCAGTTCAGCGCCGAACGCCGCAATTCC
CFTR-C046  AGCTCGAAGCTGATGGGGTGCGACAGCTTCGATCAGTTCAGCGCCGAACGCCGCAATTCC
CFTR-C008  AGTAGCAAGCTGATGGGCTGCGACAGCTTCGATCAGTTCAGCGCCGAGAGGAGGAACAGC
CFTR-C033  AGTAGCAAGCTGATGGGCTGCGACAGCTTCGATCAGTTCAGCGCCGAGAGGAGGAACAGC
CFTR-C022  AGCAGCAAACTGATGGGCTGTGACTCCTTTGATCAGTTCAGCGCCGAGAGGCGGAATAGC
CFTR-C047  AGCAGCAAACTGATGGGCTGTGACTCCTTTGATCAGTTCAGCGCCGAGAGGCGGAATAGC
CFTR-C017  AGCTCCAAGCTCATGGGCTGCGACAGCTTCGATCAGTTCAGCGCCGAAAGGCGCAACTCC
CFTR-C042  AGCTCCAAGCTCATGGGCTGCGACAGCTTCGATCAGTTCAGCGCCGAAAGGCGCAACTCC
CFTR-C020  AGCAGCAAACTGATGGGCTGCGACAGCTTCGACCAGTTCTCGGCCGAACGGCGTAATTCC
CFTR-C045  AGCAGCAAACTGATGGGCTGCGACAGCTTCGACCAGTTCTCGGCCGAACGGCGTAATTCC
CFTR-C013  TCCAGCAAGCTCATGGGGTGCGACAGCTTTGACCAGTTCAGCGCCGAACGTCGGAACTCC
CFTR-C038  TCCAGCAAGCTCATGGGGTGCGACAGCTTTGACCAGTTCAGCGCGGAACGTCGGAACTCC
CFTR-C002  TCCTCCAAGCTGATGGGCTGCGACTCCTTCGATCAGTTCAGCGCCGAAAGGCGTAATAGC
CFTR-C027  TCCTCCAAGCTGATGGGCTGCGACTCCTTCGATCAGTTCAGCGCCGAAAGGCGTAATAGC
CFTR-C011  AGCAGCAAGCTGATGGGCTGCGACAGCTTCGACCAGTTCAGCGCCGAAAGGAGGAACTCC
CFTR-C036  AGCAGCAAGCTGATGGGCTGCGACAGCTTCGACCAGTTCAGCGCCGAAAGGAGGAACTCC
CFTR-C005  AGCTCCAAGCTGATGGGATGCGACTCCTTTGACCAGTTCAGCGCCGAGAGGCGCAACAGC
CFTR-C030  AGCTCCAAGCTGATGGGATGCGACTCCTTTGACCAGTTCAGCGCCGAGAGGCGCAACAGC
CFTR-C006  AGCAGCAAGCTGATGGGATGTGATTCCTTCGACCAGTTCAGCGCAGAAAGGAGGAACTCC
CFTR-C031  AGCAGCAAGCTGATGGGATGTGATTCCTTCGACCAGTTCAGCGCAGAAAGGAGGAACTCC
CFTR-C018  AGCAGCAAGCTGATGGGCTGCGATTCCTTCGACCAGTTTAGCGCCGAGCGGCGCAACAGC
CFTR-C043  AGCAGCAAGCTGATGGGCTGCGATTCCTTCGACCAGTTTAGCGCCGAGCGGCGCAACAGC
CFTR-C003  AGCAGCAAGCTGATGGGCTGCGATAGCTTCGACCAGTTCTCCGCCGAGAGGCGGAACAGC
CFTR-C028  AGCAGCAAGCTGATGGGCTGCGATAGCTTCGACCAGTTCTCCGCCGAGAGGCGGAACAGC
CFTR-C016  AGCAGCAAGCTGATGGGCTGCGACAGCTTCGACCAGTTCAGCGCCGAGCGCAGGAATAGC
CFTR-C041  AGCAGCAAGCTGATGGGCTGCGACAGCTTCGACCAGTTCAGCGCCGAGCGCAGGAATAGC
CFTR-C010  TCGTCGAAGCTCATGGGTTGTGATAGCTTCGATCAGTTCAGCGCGGAGCGAAGGAACTCC
CFTR-C035  TCGTCGAAGCTCATGGGTTGTGATAGCTTCGATCAGTTCAGCGCGGAGCGAAGGAACTCC
CFTR-C012  AGCTCCAAGCTGATGGGTTGCGACAGCTTCGACCAGTTCAGCGCCGAGAGGCGGAACAGC
CFTR-C037  AGCTCCAAGCTGATGGGTTGCCACAGCTTCGACCAGTTCAGCGCCGAGAGGCGGAACAGC
CFTR-C009  TCTAGCAAGCTCATGGGGTGCGACTCGTTCGACCAGTTCAGCGCCGAAAGGCGGAACAGC
CFTR-C034  TCTAGCAAGCTCATGGGGTGCGACTCGTTCGACCAGTTCAGCGCCGAAAGGCGGAACAGC
CFTR-C015  TCCTCCAAGCTGATGGGCTGCGATTCCTTCGATCAGTTCAGCGCCGAGAGGAGGAACAGC
CFTR-C040  TCCTCCAAGCTGATGGGCTGCGATTCCTTCGATCAGTTCAGCGCCGAGAGGAGGAACAGC
CFTR-C019  AGCTCTAAGCTGATGGGGTGCGATAGTTTCGACCAATTCAGCGCCGAGAGGAGGAATAGC
CFTR-C044  AGCTCTAAGCTGATGGGGTGCGATAGTTTCGACCAATTCAGCGCCGAGAGGAGGAATAGC
CFTR-C007  TCCAGCAAGCTGATGGGCTGCGATAGCTTTGACCAGTTCAGCGCCGAGAGGCGCAACAGC
CFTR-C032  TCCAGCAAGCTGATGGGCTGCGATAGCTTTGACCAGTTCAGCGCCGAGAGGCGCAACAGC
CFTR-C014  TCCAGCAAGCTGATGGGGTGCGACTCCTTTGACCAGTTCAGCGCCGAGAGACGCAACTCC
CFTR-C039  TCCAGCAAGCTGATGGGGTGCGACTCCTTTGACCAGTTCAGCGCCGAGAGACGCAACTCC
CFTR-C025  TCTAGCAAGCTGATGGGTTGCGATTCCTTCGACCAGTTCAGCGCCGAGAGGCGGAACTCC
CFTR-C050  TCTAGCAAGCTGATGGGTTGCGATTCCTTCGACCAGTTCAGCGCCGAGAGGCGGAACTCC
CFTR-C023  AGCTCCAAGCTGATGGGCTGCGATAGCTTCGACCAGTTCTCCGCCGAGCGCAGGAACTCC
CFTR-C048  AGCTCCAAGCTGATGGGCTGCGATAGCTTCGACCAGTTCTCCGCCGAGCGCAGGAACTCC
CFTR-C024  AGCAGCAAGCTGATGGGATGCGACTCATTCGATCAATTCAGCGCCGAGCGGAGGAACTCC
CFTR-C049  AGCAGCAAGCTGATGGGATGCGACTCATTCGATCAATTCAGCGCCGAGCGGAGGAACTCC
           **,** ***** **,**,   **,**,**,**,    ** **, *   * **,
```

FIG. 10 (cont)

```
CFTR-WT    ATCCTAACTGAGACCTTACACCGTTTCTCATTAGAAGGAGATGCTCCTGTCTCCTGGACA
CFTR-C001  ATTCTGACCGAAACCTTGCATAGGTTTTCCCTGGAGGGCGATGCCCCCGTGAGCTGGACC
CFTR-C026  ATTCTGACCGAAACCTTGCATAGGTTTTCCCTGGAGGGCGATGCCCCCGTGAGCTGGACC
CFTR-C004  ATCCTGACCGAAACCCTCCACAGGTTCTCACTGGAGGGCGATGCCCCCGTGTCCTGGACC
CFTR-C029  ATCCTGACCGAAACCCTCCACAGGTTCTCACTGGAGGGCGATGCCCCCGTGTCCTGGACC
CFTR-C021  ATCCTGACCGAAACCCTGCATAGGTTCTCTCTGGAGGGCGACGCCCCCGTGTCCTGGACC
CFTR-C046  ATCCTGACCGAAACCCTGCATAGGTTCTCTCTGGAGGGCGACGCCCCCGTGTCCTGGACC
CFTR-C008  ATCCTCACAGAGACCCTGCACCGGTTTAGCCTGGAGGGCGACGCGCCCGTGTCCTGGACC
CFTR-C033  ATCCTCACAGAGACCCTGCACCGGTTTAGCCTGGAGGGCGACGCGCCCGTGTCCTGGACC
CFTR-C022  ATCCTGACCGAGACCCTGCACCGGTTCTCTCTGGAAGGTGATGCCCCCGTGAGCTGGACC
CFTR-C047  ATCCTGACCGAGACCCTGCACCGGTTCTCTCTGGAAGGTGATGCCCCCGTGAGCTGGACC
CFTR-C017  ATCCTGACGGAGACCCTGCACAGGTTCAGCCTCGAGGGCGACGCCCCCGTCTCGTGGACC
CFTR-C042  ATCCTGACGGAGACCCTGCACAGGTTCAGCCTCGAGGGCGACGCCCCCGTCTCGTGGACC
CFTR-C020  ATCCTCACCGAGACCCTGCACAGGTTCTCCCTGGAGGGCGACGCCCCCGTGTCCTGGACC
CFTR-C045  ATCCTCACCGAGACCCTGCACAGGTTCTCCCTGGAGGGCGACGCCCCCGTGTCCTGGACC
CFTR-C013  ATCCTGACCGAGACCCTGCATAGGTTCAGCCTGGAGGGGGACGCCCCGGTCAGCTGGACC
CFTR-C038  ATCCTGACCGAGACCTGCATAGGTTCAGCCTGGAGGGGGACGCCCCGGTCAGCTGGACC
CFTR-C002  ATCCTCACAGAGACCCTCCATCGCTTCAGCCTGGAGGGCGACGCCCCCGTCAGCTGGACC
CFTR-C027  ATCCTCACAGAGACCCTCCATCGCTTCAGCCTGGAGGGCGACGCCCCCGTCAGCTGGACC
CFTR-C011  ATCCTCACGGAGACCCTGCACAGGTTCAGCCTGGAGGGCGATGCGCCGGTCTCCTGGACC
CFTR-C036  ATCCTCACGGAGACCCTGCACAGGTTCAGCCTGGAGGGCGATGCGCCGGTCTCCTGGACC
CFTR-C005  ATCCTGACAGAGACCCTGCACCGGTTCTCCCTTGAGGGCGACGCGCCCGTCAGCTGGACC
CFTR-C030  ATCCTGACAGAGACCCTGCACCGGTTCTCCCTTGAGGGCGACGCGCCCGTCAGCTGGACC
CFTR-C006  ATCCTGACCGAGACCCTGCACCGCTTCAGTCTCGAGGGAGATGCACCCGTGAGCTGGACC
CFTR-C031  ATCCTGACCGAGACCCTGCACCGCTTCAGTCTCGAGGGAGATGCACCCGTGAGCTGGACC
CFTR-C018  ATCCTGACGGAGACCCTGCACAGGTTCAGCCTCGAAGGCGACGCGCCCGTTAGCTGGACC
CFTR-C043  ATCCTGACGGAGACCCTGCACAGGTTCAGCCTCGAAGGCGACGCGCCCGTTAGCTGGACC
CFTR-C003  ATCCTGACAGAGACCCTGCACAGGTTCAGCCTCGAGGGGGACGCCCCCGTGAGCTGGACC
CFTR-C028  ATCCTGACAGAGACCCTGCACAGGTTCAGCCTCGAGGGGGACGCCCCCGTGAGCTGGACC
CFTR-C016  ATCCTGACCGAGACCCTGCACCGGTTTAGCCTCGAAGGAGACGCGCCCGTGAGCTGGACC
CFTR-C041  ATCCTGACCGAGACCCTGCACCGGTTTAGCCTCGAAGGAGACGCGCCCGTGAGCTGGACC
CFTR-C010  ATCCTGACCGAGACCCTGCACAGGTTCTCCCTGGAAGGGGACGCCCCCGTGAGCTGGACC
CFTR-C035  ATCCTGACCGAGACCCTGCACAGGTTCTCCCTGGAAGGGGACGCCCCCGTGAGCTGGACC
CFTR-C012  ATACTGACCGAGACCCTGCATAGGTTCTCCCTCGAGGGGGACGCCCCGGTGTCCTGGACG
CFTR-C037  ATACTGACCGAGACCCTGCATAGGTTCTCCCTCGAGGGGGACGCCCCGGTGTCCTGGACG
CFTR-C009  ATCCTGACTGAGACCCTGCACAGGTTCAGCCTGGAGGGGGATGCCCCCGTGAGCTGGACT
CFTR-C034  ATCCTGACTGAGACCCTGCACAGGTTCAGCCTGGAGGGGGATGCCCCCGTGAGCTGGACT
CFTR-C015  ATACTGACCGAGACCCTGCATAGGTTCAGCCTCGAGGCGATGCCCCCGTGTCCTGGACC
CFTR-C040  ATACTGACCGAGACCCTGCATAGGTTCAGCCTCGAGGCGATGCCCCCGTGTCCTGGACC
CFTR-C019  ATCCTGACGGAAACCCTCCACAGGTTCAGCCTGGAGGGCGACGCACCGGTGAGCTGGACC
CFTR-C044  ATCCTGACGGAAACCCTCCACAGGTTCAGCCTGGAGGGCGACGCACCGGTGAGCTGGACC
CFTR-C007  ATCCTGACCGAGACCCTGCACAGGTTTTCACTGGAAGGCGACGCCCCCGTCAGCTGGACG
CFTR-C032  ATCCTGACCGAGACCCTGCACAGGTTTTCACTGGAAGGCGACGCCCCCGTCAGCTGGACG
CFTR-C014  ATACTGACCGAAACCCTGCACCGATTTTCCCTCGAGGCGATGCGCCGGTGTCCTGGACC
CFTR-C039  ATACTGACCGAAACCCTGCACCGATTTTCCCTCGAGGCGATGCGCCGGTGTCCTGGACC
CFTR-C025  ATCCTGACCGAGACCCTGCATCGGTTCTCCCTGGAGGGCGACGCCCCCGTGAGCTGGACT
CFTR-C050  ATCCTGACCGAGACCCTGCATCGGTTCTCCCTGGAGGGCGACGCCCCCGTGAGCTGGACT
CFTR-C023  ATACTCACCGAGACGCTGCACAGGTTCTCGCTCGAAGGCGACGCCCCGTGTCCTGGACC
CFTR-C048  ATACTCACCGAGACGCTGCACAGGTTCTCGCTCGAAGGCGACGCCCCGTGTCCTGGACC
CFTR-C024  ATCCTGACCGAAACACTCCATCGGTTTAGCCTGGAGGGCGACGCACCCGTCTCCTGGACC
CFTR-C049  ATCCTGACCGAAACACTCCATCGGTTTAGCCTGGAGGGCGACGCACCCGTCTCCTGGACC
           ** ** ** **,**  ,* **,  * **,    ,* **,** **,** ** **      *****
```

FIG. 10 (cont)

| | |
|---|---|
| CFTR-WT | GAAACAAAAAAACAATCTTTTAAACAGACTGGAGAGTTTGGGGAAAAAAGGAAGAATTCT |
| CFTR-C001 | GAGACCAAGAAACAGAGCTTCAAGCAGACCGGCGAATTTGGGGAGAAGAGGAAGAACTCC |
| CFTR-C026 | GAGACCAAGAAACAGAGCTTCAAGCAGACCGGCGAATTTGGGGAGAAGAGGAAGAACTCC |
| CFTR-C004 | GAGACCAAGAAACAGAGCTTCAAGCAGACCGGGGAGTTCGGCGAAAAACGTAAGAACAGC |
| CFTR-C029 | GAGACCAAGAAACAGAGCTTCAAGCAGACCGGGGAGTTCGGCGAAAAACGTAAGAACAGC |
| CFTR-C021 | GAAACCAAGAAGCAGAGCTTCAAGCAAACCGGGGAGTTCGGCGAGAAAAGGAAGAACAGC |
| CFTR-C046 | GAAACCAAGAAGCAGAGCTTCAAGCAAACCGGGGAGTTCGGCGAGAAAAGGAAGAACAGC |
| CFTR-C008 | GAGACCAAGAAGCAAAGCTTCAAGCAAACCGGCGAGTTCGGCGAGAAAAGAAAGAACAGC |
| CFTR-C033 | GAGACCAAGAAGCAAAGCTTCAAGCAAACCGGCGAGTTCGGCGAGAAAAGAAAGAACAGC |
| CFTR-C022 | GAGACCAAGAAGCAGAGCTTCAAGCAGACCGGCGAGTTTGGCGAGAAGAGGAAGAACAGC |
| CFTR-C047 | GAGACCAAGAAGCAGAGCTTCAAGCAGACCGGCGAGTTTGGCGAGAAGAGGAAGAACAGC |
| CFTR-C017 | GAGACCAAAAAGCAGAGCTTCAAGCAGACCGGCGAGTTCGGCGAGAAGCGAAAAACAGC |
| CFTR-C042 | GAGACCAAAAAGCAGAGCTTCAAGCAGACCGGCGAGTTCGGCGAGAAGCGAAAAACAGC |
| CFTR-C020 | GAGACCAAAAAGCAGTCATTCAAGCAAACCGGTGAGTTCGGCGAGAAGCGAAAAAACTCT |
| CFTR-C045 | GAGACCAAAAAGCAGTCATTCAAGCAAACCGGTGAGTTCGGCGAGAAGCGAAAAAACTCT |
| CFTR-C013 | GAGACAAAGAAGCAGTCCTTTAAGCAGACCGGCGAGTTCGGAGAGAAACGCAAAAACAGC |
| CFTR-C038 | GAGACAAAGAAGCAGTCCTTTAAGCAGACCGGCGAGTTCGGAGAGAAACGCAAAAACAGC |
| CFTR-C002 | GAGACGAAGAAGCAGAGCTTCAAGCAGACCGGCGAGTTCGGCGAGAAGCGGAAGAACTCC |
| CFTR-C027 | GAGACGAAGAAGCAGAGCTTCAAGCAGACCGGCGAGTTCGGCGAGAAGCGGAAGAACTCC |
| CFTR-C011 | GAAACGAAAAAGCAGTCCTTCAAGCAGACCGGCGAGTTCGGAGAAAAACGAAAGAATTCC |
| CFTR-C036 | GAAACGAAAAAGCAGTCCTTCAAGCAGACCGGCGAGTTCGGAGAAAAACGAAAGAATTCC |
| CFTR-C005 | GAGACGAAGAAGCAGAGCTTCAAACAGACCGGCGAGTTCGGCGAGAAGAGGAAGAATTCA |
| CFTR-C030 | GAGACGAAGAAGCAGAGCTTCAAACAGACCGGCGAGTTCGGCGAGAAGAGGAAGAATTCA |
| CFTR-C006 | GAGACCAAGAAGCAGTCCTTCAAGCAGACCGGTGAATTCGGCGAGAAGCGCAAAAATTCC |
| CFTR-C031 | GAGACCAAGAAGCAGTCCTTCAAGCAGACCGGTGAATTCGGCGAGAAGCGCAAAAATTCC |
| CFTR-C018 | GAGACGAAGAAGCAGTCCTTCAAGCAAACCGGGGAGTTCGGTGAAAAGCGGAAGAACAGC |
| CFTR-C043 | GAGACGAAGAAGCAGTCCTTCAAGCAAACCGGGGAGTTCGGTGAAAAGCGGAAGAACAGC |
| CFTR-C003 | GAAACCAAAAAGCAGAGCTTTAAGCAGACCGGCGAGTTCGGCGAAAAACGAAAGAACAGC |
| CFTR-C028 | GAAACCAAAAAGCAGAGCTTTAAGCAGACCGGCGAGTTCGGCGAAAAACGAAAGAACAGC |
| CFTR-C016 | GAGACCAAGAAGCAGAGCTTCAAGCAGACAGGCGAGTTCGGCGAGAAGAGGAAGAATAGC |
| CFTR-C041 | GAGACCAAGAAGCAGAGCTTCAAGCAGACAGGCGAGTTCGGCGAGAAGAGGAAGAATAGC |
| CFTR-C010 | GAGACCAAGAAGCAAAGCTTCAAGCAGACCGGAGAGTTTGGGGAGAAGCGCAAGAATAGC |
| CFTR-C035 | GAGACCAAGAAGCAAAGCTTCAAGCAGACCGGAGAGTTTGGGGAGAAGCGCAAGAATAGC |
| CFTR-C012 | GAGACCAAAAAACAGAGCTTCAAGCAGACGGGGGAATTCGGCGAGAAGCGGAAAAACAGC |
| CFTR-C037 | GAGACCAAAAAACAGAGCTTCAAGCAGACGGGGGAATTCGGCGAGAAGCGGAAAAACAGC |
| CFTR-C009 | GAAACCAAGAAGCAGTCCTTCAAGCAGACCGGCGAGTTTGGCGAGAAGAGGAAGAACAGC |
| CFTR-C034 | GAAACCAAGAAGCAGTCCTTCAAGCAGACCGGCGAGTTTGGCGAGAAGAGGAAGAACAGC |
| CFTR-C015 | GAGACCAAAAAACAGTCCTTCAAGCAGACCGGGGAGTTCGGGGAGAAGCGCAAGAACAGC |
| CFTR-C040 | GAGACCAAAAAACAGTCCTTCAAGCAGACCGGGGAGTTCGGGGAGAAGCGCAAGAACAGC |
| CFTR-C019 | GAAACCAAGAAGCAAAGCTTCAAGCAGACCGGGGAGTTTGGGGAGAAGAGGAAGAACAGC |
| CFTR-C044 | GAAACCAAGAAGCAAAGCTTCAAGCAGACCGGGGAGTTTGGGGAGAAGAGGAAGAACAGC |
| CFTR-C007 | GAGACAAAGAAGCAGTCATTCAAGCAGACCGGCGAGTTTGGCGAGAAGAGGAAGAACTCT |
| CFTR-C032 | GAGACAAAGAAGCAGTCATTCAAGCAGACCGGCGAGTTTGGCGAGAAGAGGAAGAACTCT |
| CFTR-C014 | GAGACCAAGAAGCAGAGCTTCAAGCAGACCGGCGAGTTTGGGGAAAAGAGGAAGAACTCG |
| CFTR-C039 | GAGACCAAGAAGCAGAGCTTCAAGCAGACCGGCGAGTTTGGGGAAAAGAGGAAGAACTCG |
| CFTR-C025 | GAAACCAAAAAGCAGAGCTTCAAGCAGACGGGAGAATTCGGCGAGAAGAGGAAGAACTCG |
| CFTR-C050 | GAAACCAAAAAGCAGAGCTTCAAGCAGACGGGAGAATTCGGCGAGAAGAGGAAGAACTCG |
| CFTR-C023 | GAGACCAAGAAACAGTCCTTTAAGCAGACCGGCGAGTTCGGAGAGAAGAGGAAGAACAGC |
| CFTR-C048 | GAGACCAAGAAACAGTCCTTTAAGCAGACCGGCGAGTTCGGAGAGAAGAGGAAGAACAGC |
| CFTR-C024 | GAAACCAAGAAACAGAGCTTCAAGCAGACCGGCGAGTTTGGGGAGAAGCGAAAGAACTCC |
| CFTR-C049 | GAAACCAAGAAACAGAGCTTCAAGCAGACCGGCGAGTTTGGGGAGAAGCGAAAGAACTCC |
| | , , , ,   , , , ,  , , , , ,** * , **, |

FIG. 10 (cont)

```
CFTR-WT   ATTCTCAATCCAATCAACTCTATACGAAAATTTTCCATTGTGCAAAAGACTCCCTTACAA
CFTR-C001 ATCCTGAATCCCATAAACAGCATCAGGAAATTCAGCATCGTGCAAAAAACCCCCCTCCAG
CFTR-C026 ATCCTGAATCCCATAAACAGCATCAGGAAATTCAGCATCGTGCAAAAAACCCCCCTCCAG
CFTR-C004 ATACTGAACCCAATAAATAGCATCAGGAAGTTCTCGATCGTGCAGAAGACCCCCCTCCAA
CFTR-C029 ATACTGAACCCAATAAATAGCATCAGGAAGTTCTCGATCGTGCAGAAGACCCCCCTCCAA
CFTR-C021 ATCCTGAACCCCATCAATAGCATCAGGAAGTTCAGCATCGTGCAGAAAACCCCCCTGCAG
CFTR-C046 ATCCTGAACCCCATCAATAGCATCAGGAAGTTCAGCATCGTGCAGAAAACCCCCCTGCAG
CFTR-C008 ATCCTGAACCCCATCAACAGCATCCGCAAGTTCTCCATCGTGCAGAAGACCCCCCTCCAG
CFTR-C033 ATCCTGAACCCCATCAACAGCATCCGCAAGTTCTCCATCGTGCAGAAGACCCCCCTCCAG
CFTR-C022 ATCCTGAATCCCATCAACAGCATCCGGAAGTTCAGCATCGTGCAGAAAACCCCCCTCCAG
CFTR-C047 ATCCTGAATCCCATCAACAGCATCCGGAAGTTCAGCATCGTGCAGAAAACCCCCCTCCAG
CFTR-C017 ATCCTGAACCCCATCAATAGCATCAGGAAATTCTCCATCGTGCAGAAGACCCCGCTGCAG
CFTR-C042 ATCCTGAACCCCATCAATAGCATCAGGAAATTCTCCATCGTGCAGAAGACCCCGCTGCAG
CFTR-C020 ATCCTGAACCCCATCAACAGCATCCGCAAATTCAGCATCGTCCAGAAGACCCCACTCCAG
CFTR-C045 ATCCTGAACCCCATCAACAGCATCCGCAAATTCAGCATCGTCCAGAAGACCCCACTCCAG
CFTR-C013 ATCCTGAACCCCATCAATAGCATCAGGAAGTTTAGCATCGTGCAGAAGACCCCCCTGCAG
CFTR-C038 ATCCTGAACCCCATCAATAGCATCAGGAAGTTTAGCATCGTGCAGAAGACCCCCCTGCAG
CFTR-C002 ATCCTCAACCCGATCAACAGCATCCGCAAGTTCAGCATCGTGCAGAAGACCCCCCTGCAG
CFTR-C027 ATCCTCAACCCGATCAACAGCATCCGCAAGTTCAGCATCGTGCAGAAGACCCCCCTGCAG
CFTR-C011 ATCCTGAACCCCATAAACTCCATCCGGAAATTCTCCATCGTGCAGAAGACCCCGCTGCAG
CFTR-C036 ATCCTGAACCCCATAAACTCCATCCGGAAATTCTCCATCGTGCAGAAGACCCCGCTGCAG
CFTR-C005 ATCCTGAACCCCATCAACAGCATCAGGAAATTCAGCATCGTCCAGAAGACACCCCTGCAG
CFTR-C030 ATCCTGAACCCCATCAACAGCATCAGGAAATTCAGCATCGTCCAGAAGACACCCCTGCAG
CFTR-C006 ATCCTCAATCCCATCAACTCGATCCGAAAGTTCTCCATCGTGCAGAAGACCCCCCTGCAG
CFTR-C031 ATCCTCAATCCCATCAACTCGATCCGAAAGTTCTCCATCGTGCAGAAGACCCCCCTGCAG
CFTR-C018 ATCCTGAACCCCATCAATAGCATACGTAAGTTCAGCATCGTGCAGAAGACTCCCCTGCAG
CFTR-C043 ATCCTGAACCCCATCAATAGCATACGTAAGTTCAGCATCGTGCAGAAGACTCCCCTGCAG
CFTR-C003 ATCCTGAACCCGATCAATAGCATCCGTAAGTTCAGCATAGTGCAGAAAACCCCCTTGCAG
CFTR-C028 ATCCTGAACCCGATCAATAGCATCCGTAAGTTCAGCATAGTGCAGAAAACCCCCTTGCAG
CFTR-C016 ATCCTGAACCCCATCAACAGCATCAGGAAGTTCTCCATCGTGCAGAAGACCCCCCTGCAA
CFTR-C041 ATCCTGAACCCCATCAACAGCATCAGGAAGTTCTCCATCGTGCAGAAGACCCCCCTGCAA
CFTR-C010 ATCCTGAATCCCATCAACAGCATCCGGAAGTTCTCCATCGTGCAGAAAACCCCCCTGCAG
CFTR-C035 ATCCTGAATCCCATCAACAGCATCCGGAAGTTCTCCATCGTGCAGAAAACCCCCCTGCAG
CFTR-C012 ATCCTCAACCCCATCAACAGCATCCGGAAGTTTAGCATCGTCCAGAAGACGCCCCTGCAG
CFTR-C037 ATCCTCAACCCCATCAACAGCATCCGGAAGTTTAGCATCGTCCAGAAGACGCCCCTGCAG
CFTR-C009 ATCCTGAACCCCATCAACTCGATCCGCAAGTTCAGCATAGTGCAGAAAACCCCCCTGCAA
CFTR-C034 ATCCTGAACCCCATCAACTCGATCCGCAAGTTCAGCATAGTGCAGAAAACCCCCCTGCAA
CFTR-C015 ATCCTGAACCCGATCAACAGCATCCGTAAGTTCAGCATTGTGCAAAAAACCCCCCTGCAA
CFTR-C040 ATCCTGAACCCGATCAACAGCATCCGTAAGTTCAGCATTGTGCAAAAAACCCCCCTGCAA
CFTR-C019 ATCCTGAACCCCATAAACTCCATCCGCAAGTTCAGTATCGTGCAGAAGACCCCGCTGCAA
CFTR-C044 ATCCTGAACCCCATAAACTCCATCCGCAAGTTCAGTATCGTGCAGAAGACCCCGCTGCAA
CFTR-C007 ATCCTGAACCCCATAAACAGCATCCGAAAGTTCAGCATCGTGCAGAAGACCCCCCTGCAG
CFTR-C032 ATCCTGAACCCCATAAACAGCATCCGAAAGTTCAGCATCGTGCAGAAGACCCCCCTGCAG
CFTR-C014 ATACTGAACCCCATCAACTCCATCAGGAAATTCAGCATTGTGCAGAAGACCCCCCTGCAG
CFTR-C039 ATACTGAACCCCATCAACTCCATCAGGAAATTCAGCATTGTGCAGAAGACCCCCCTGCAG
CFTR-C025 ATTCTGAACCCCATCAACAGCATCCGGAAGTTCTCCATCGTGCAGAAGACCCCCCTGCAG
CFTR-C050 ATTCTGAACCCCATCAACAGCATCCGGAAGTTCTCCATCGTGCAGAAGACCCCCCTGCAG
CFTR-C023 ATCCTGAACCCCATCAACTCCATCAGGAAGTTTAGCATCGTGCAAAAGACCCCGCTCCAG
CFTR-C048 ATCCTGAACCCCATCAACTCCATCAGGAAGTTTAGCATCGTGCAAAAGACCCCGCTCCAG
CFTR-C024 ATCCTCAACCCGATCAACAGCATCCGGAAGTTTAGCATCGTGCAGAAGACACCCCTGCAG
CFTR-C049 ATCCTCAACCCGATCAACAGCATCCGGAAGTTTAGCATCGTGCAGAAGACACCCCTGCAG
          ** ** **,** ** **,     ** **,**,** ** ,** **,
```

FIG. 10 (cont)

```
CFTR-WT   ATGAATGGCATCGAAGAGGATTCTGATGAGCCTTTAGAGAGAAGGCTGTCCTTAGTACCA
CFTR-C001 ATGAATGGGATCGAGGAGGACTCGGATGAGCCCCTCGAGCGGAGGCTGAGCCTGGTGCCA
CFTR-C026 ATGAATGGGATCGAGGAGGACTCGGATGAGCCCCTCGAGCGGAGGCTGAGCCTGGTGCCA
CFTR-C004 ATGAACGGCATCGAGGAGGACAGCGACGAGCCCCTGGAGCGGCGCCTGAGCCTGGTGCCC
CFTR-C029 ATGAACGGCATCGAGGAGGACAGCGACGAGCCCCTGGAGCGGCGCCTGAGCCTGGTGCCC
CFTR-C021 ATGAACGGCATCGAGGAGGATTCCGACGAACCCCTCGAGAGGCGGCTGAGCCTAGTGCCC
CFTR-C046 ATGAACGGCATCGAGGAGGATTCCGACGAACCCCTCGAGAGGCGGCTGAGCCTAGTGCCC
CFTR-C008 ATGAACGGGATCGAGGAGGACAGCGACGAGCCCCTGGAGCGGCGGCTGAGCCTCGTGCCC
CFTR-C033 ATGAACGGGATCGAGGAGGACAGCGACGAGCCCCTGGAGCGGCGGCTGAGCCTCGTGCCC
CFTR-C022 ATGAACGGCATCGAGGAGGATAGCGACGAGCCCCTGGAGAGGCGGCTCAGCCTGGTGCCC
CFTR-C047 ATGAACGGCATCGAGGAGGATAGCGACGAGCCCCTGGAGAGGCGGCTCAGCCTGGTGCCC
CFTR-C017 ATGAACGGCATCGAGGAGGACAGCGACGAGCCCCTGGAAAGGAGGCTCAGCCTGGTGCCG
CFTR-C042 ATGAACGGCATCGAGGAGGACAGCGACGAGCCCCTGGAAAGGAGGCTCAGCCTGGTGCCG
CFTR-C020 ATGAACGGGATCGAGGAGGACTCCGATGAGCCCCTGGAGAGGAGGCTCAGCCTGGTGCCC
CFTR-C045 ATGAACGGGATCGAGGAGGACTCCGATGAGCCCCTGGAGAGGAGGCTCAGCCTGGTGCCC
CFTR-C013 ATGAACGGCATTGAGGAGGACAGCGACGAACCCCTGGAGCGCAGGCTGAGCCTGGTGCCC
CFTR-C038 ATGAACGGCATTGAGGAGGACAGCGACGAACCCCTGGAGCGCAGGCTGAGCCTGGTGCCC
CFTR-C002 ATGAACGGCATAGAGGAGGACTCCGATGAACCCCTGGAGAGGAGGCTGAGCCTGGTGCCT
CFTR-C027 ATGAACGGCATAGAGGAGGACTCCGATGAACCCCTGGAGAGGAGGCTGAGCCTGGTGCCT
CFTR-C011 ATGAACGGGATCGAGGAGGACAGCGACGAGCCCCTGGAGCGAAGGCTGTCCCTGGTGCCC
CFTR-C036 ATGAACGGGATCGAGGAGGACAGCGACGAGCCCCTGGAGCGAAGGCTGTCCCTGGTGCCC
CFTR-C005 ATGAACGGCATCGAGGAGGACAGCGATGAGCCCCTGGAAAGGCGTCTGAGCCTGGTGCCC
CFTR-C030 ATGAACGGCATCGAGGAGGACAGCGATGAGCCCCTGGAAAGGCGTCTGAGCCTGGTGCCC
CFTR-C006 ATGAATGGCATCGAGGAGGACAGCGACGAGCCCCTGGAAAGGAGGCTGAGCCTGGTGCCC
CFTR-C031 ATGAATGGCATCGAGGAGGACAGCGACGAGCCCCTGGAAAGGAGGCTGAGCCTGGTGCCC
CFTR-C018 ATGAATGGCATCGAGGAAGACTCCGACGAGCCACTCGAGCGGAGGCTGAGCCTGGTGCCC
CFTR-C043 ATGAATGGCATCGAGGAAGACTCCGACGAGCCACTCGAGCGGAGGCTGAGCCTGGTGCCC
CFTR-C003 ATGAACGGCATAGAGGAGGATAGCGACGAACCGCTCGAGAGGAGGCTGAGCCTGGTCCCA
CFTR-C028 ATGAACGGCATAGAGGAGGATAGCGACGAACCGCTCGAGAGGAGGCTGAGCCTGGTCCCA
CFTR-C016 ATGAACGGCATCGAGGAGGATAGCGATGAACCCCTCGAGAGGAGGCTGAGCCTGGTGCCG
CFTR-C041 ATGAACGGCATCGAGGAGGATAGCGATGAACCCCTCGAGAGGAGGCTGAGCCTGGTGCCG
CFTR-C010 ATGAACGGCATCGAGGAGGATAGCGACGAGCCCCTTGAGAGGCGGCTGAGCCTGGTGCCC
CFTR-C035 ATGAACGGCATCGAGGAGGATAGCGACGAGCCCCTTGAGAGGCGGCTGAGCCTGGTGCCC
CFTR-C012 ATGAACGGCATCGAGGAGGACAGCGATGAGCCCCTCGAGAGGAGGCTGAGCCTGGTGCCC
CFTR-C037 ATGAACGGCATCGAGGAGGACAGCGATGAGCCCCTCGAGAGGAGGCTGAGCCTGGTGCCC
CFTR-C009 ATGAACGGCATCGAGGAGGACTCCGACGAACCCCTCGAGAGGAGGCTGAGCCTCGTGCCG
CFTR-C034 ATGAACGGCATCGAGGAGGACTCCGACGAACCCCTCGAGAGGAGGCTGAGCCTCGTGCCG
CFTR-C015 ATGAATGGCATCGAGGAAGACTCCGACGAGCCCCTGGAGCGCCGGCTGAGCCTGGTCCCC
CFTR-C040 ATGAATGGCATCGAGGAAGACTCCGACGAGCCCCTGGAGCGCCGGCTGAGCCTGGTCCCC
CFTR-C019 ATGAACGGCATCGAAGAGGACAGCGATGAGCCCCTGGAACGGAGGCTGTCTCTGGTGCCG
CFTR-C044 ATGAACGGCATCGAAGAGGACAGCGATGAGCCCCTGGAACGGAGGCTGTCTCTGGTGCCG
CFTR-C007 ATGAACGGCATCGAGGAGGACTCCGACGAGCCCCTCGAGCGGCGGCTGTCGCTGGTCCCG
CFTR-C032 ATGAACGGCATCGAGGAGGACTCCGACGAGCCCCTCGAGCGGCGGCTGTCGCTGGTCCCG
CFTR-C014 ATGAACGGCATCGAGGAAGACAGCGATGAGCCCCTGGAGAGGAGGCTGTCCCTGGTGCCG
CFTR-C039 ATGAACGGCATCGAGGAAGACAGCGATGAGCCCCTGGAGAGGAGGCTGTCCCTGGTGCCG
CFTR-C025 ATGAACGGGATCGAAGAGGACTCTGATGAGCCCCTGGAGAGGAGGCTGAGCCTCGTGCCC
CFTR-C050 ATGAACGGGATCGAAGAGGACTCTGATGAGCCCCTGGAGAGGAGGCTGAGCCTCGTGCCC
CFTR-C023 ATGAATGGCATCGAGGAAGACTCCGACGAACCCCTCGAGCGCCGGCTGAGCCTGGTGCCG
CFTR-C048 ATGAATGGCATCGAGGAAGACTCCGACGAACCCCTCGAGCGCCGGCTGAGCCTGGTGCCG
CFTR-C024 ATGAACGGCATCGAGGAGGACAGCGACGAGCCACTGGAGAGGCGACTGAGCCTGGTGCCG
CFTR-C049 ATGAACGGCATCGAGGAGGACAGCGACGAGCCACTGGAGAGGCGACTGAGCCTGGTGCCG
          *****.**.**.**.**.**.    **.**.**. .*.**. *   * **     .* **.**
```

FIG. 10 (cont)

```
CFTR-WT   GATTCTGAGCAGGGAGAGGCGATACTGCCTCGCATCAGCGTGATCAGCACTGGCCCCACG
CFTR-C001 GACTCCGAGCAGGGCGAGGCAATCCTGCCCAGGATCAGCGTTATCAGCACCGGGCCGACC
CFTR-C026 GACTCCGAGCAGGGCGAGGCAATCCTGCCCAGGATCAGCGTTATCAGCACCGGGCCGACC
CFTR-C004 GACAGCGAACAAGGCGAGGCGATCCTGCCCAGGATCAGCGTAATCAGCACCGGTCCCACC
CFTR-C029 GACAGCGAACAAGGCGAGGCGATCCTGCCCAGGATCAGCGTAATCAGCACCGGTCCCACC
CFTR-C021 GACTCCGAGCAGGGGGAAGCCATACTGCCCCGCATCAGCGTGATCTCCACCGGCCCCACC
CFTR-C046 GACTCCGAGCAGGGGGAAGCCATACTGCCCCGCATCAGCGTGATCTCCACCGGCCCCACC
CFTR-C008 GACAGCGAGCAGGGCGAGGCCATCCTGCCCAGGATATCCGTGATCAGCACCGGGCCCACC
CFTR-C033 GACAGCGAGCAGGGCGAGGCCATCCTGCCCAGGATATCCGTGATCAGCACCGGGCCCACC
CFTR-C022 GACAGCGAGCAGGGGGAGGCCATCCTGCCCAGGATCAGCGTCATCAGCACTGGCCCCACC
CFTR-C047 GACAGCGAGCAGGGGGAGGCCATCCTGCCCAGGATCAGCGTCATCAGCACTGGCCCCACC
CFTR-C017 GACAGCGAACAGGGAGAGGCCATCCTGCCTAGGATCAGCGTGATCAGCACCGGCCCCACA
CFTR-C042 GACAGCGAACAGGGAGAGGCCATCCTGCCTAGGATCAGCGTGATCAGCACCGGCCCCACA
CFTR-C020 GACTCCGAGCAGGGGGAGGCCATCCTGCCCAGGATCTCGGTCATCAGCACCGGGCCCACC
CFTR-C045 GACTCCGAGCAGGGGGAGGCCATCCTGCCCAGGATCTCGGTCATCAGCACCGGGCCCACC
CFTR-C013 GACAGCGAACAGGGCGAGGCCATCCTGCCCCGGATCAGCGTCATCAGCACCGGCCCTACC
CFTR-C038 GACAGCGAACAGGGCGAGGCCATCCTGCCCCGGATCAGCGTCATCAGCACCGGCCCTACC
CFTR-C002 GACTCTGAACAGGGGGAGGCGATCCTGCCTAGAATATCCGTCATATCCACCGGCCCCACC
CFTR-C027 GACTCTGAACAGGGGGAGGCGATCCTGCCTAGAATATCCGTCATATCCACCGGCCCCACC
CFTR-C011 GATAGCGAACAGGGCGAAGCCATCCTGCCCAGGATCAGCGTGATCAGCACCGGCCCCACG
CFTR-C036 GATAGCGAACAGGGCGAAGCCATCCTGCCCAGGATCAGCGTGATCAGCACCGGCCCCACG
CFTR-C005 GACTCCGAGCAGGGCGAGGCCATCCTCCCCAGGATCAGCGTCATCAGCACCGGCCCGACA
CFTR-C030 GACTCCGAGCAGGGCGAGGCCATCCTCCCCAGGATCAGCGTCATCAGCACCGGCCCGACA
CFTR-C006 GACTCCGAGCAAGGGGAGGCCATCCTGCCCAGGATCTCCGTGATCAGCACCGGACCCACA
CFTR-C031 GACTCCGAGCAAGGGGAGGCCATCCTGCCCAGGATCTCCGTGATCAGCACCGGACCCACA
CFTR-C018 GACAGCGAGCAGGGAGAAGCCATCCTCCCCAGGATTTCCGTGATCAGCACCGGCCCCACC
CFTR-C043 GACAGCGAGCAGGGAGAAGCCATCCTCCCCAGGATTTCCGTGATCAGCACCGGCCCCACC
CFTR-C003 GACAGCGAGCAGGGCGAGGCCATTCTCCCCAGAATCAGCGTGATCAGCACCGGCCCCACC
CFTR-C028 GACAGCGAGCAGGGCGAGGCCATTCTCCCCAGAATCAGCGTGATCAGCACCGGCCCCACC
CFTR-C016 GACAGCGAGCAGGGAGAGGCCATCCTGCCGAGGATCTCCGTGATCAGCACCGGCCCCACC
CFTR-C041 GACAGCGAGCAGGGAGAGGCCATCCTGCCGAGGATCTCCGTGATCAGCACCGGCCCCACC
CFTR-C010 GACAGCGAGCAGGGGGAGGCCATCCTGCCCCGGATCTCCGTTATCTCCACCGGCCCGACC
CFTR-C035 GACAGCGAGCAGGGGGAGGCCATCCTGCCCCGGATCTCCGTTATCTCCACCGGCCCGACC
CFTR-C012 GACAGCGAGCAGGGCGAGGCCATCCTGCCCACGGATCAGCGTGATCAGCACCGGGCCCACG
CFTR-C037 GACAGCGAGCAGGGCGAGGCCATCCTGCCCACGGATCAGCGTGATCAGCACCGGGCCCACG
CFTR-C009 GACAGCGAGCAGGGGGAGGCGATTCTCCCCCGCATCTCCGTCATCAGCACGGGTCCCACC
CFTR-C034 GACAGCGAGCAGGGGGAGGCGATTCTCCCCCGCATCTCCGTCATCAGCACGGGTCCCACC
CFTR-C015 GACAGCGAGCAGGGGGAGGCGATCCTGCCCAGAATCTCTGTGATAAGCACCGGCCCCACG
CFTR-C040 GACAGCGAGCAGGGGGAGGCGATCCTGCCCAGAATCTCTGTGATAAGCACCGGCCCCACG
CFTR-C019 GACAGCGAGCAGGGCGAGGCAATACTGCCCCGCATCAGCGTGATCTCCACTGGCCCGACG
CFTR-C044 GACAGCGAGCAGGGCGAGGCAATACTGCCCCGCATCAGCGTGATCTCCACTGGCCCGACG
CFTR-C007 GACAGCGAACAGGGCGAGGCAATACTCCCCAGGATCTCCGTGATCAGCACCGGGCCCACC
CFTR-C032 GACAGCGAACAGGGCGAGGCAATACTCCCCAGGATCTCCGTGATCAGCACCGGGCCCACC
CFTR-C014 GACTCCGAGCAGGGCGAGGCCATACTGCCCAGGATCTCCGTGATCAGCACCGGGCCCACC
CFTR-C039 GACTCCGAGCAGGGCGAGGCCATACTGCCCAGGATCTCCGTGATCAGCACCGGGCCCACC
CFTR-C025 GACTCCGAGCAGGGCGAGGCCATACTGCCCCGTATCAGCGTGATCAGCACCGGCCCCACC
CFTR-C050 GACTCCGAGCAGGGCGAGGCCATACTGCCCCGTATCAGCGTGATCAGCACCGGCCCCACC
CFTR-C023 GATAGCGAGCAAGGGGAGGCCATCCTGCCCCGCATCTCCGTGATCTCCACCGGGCCCACG
CFTR-C048 GATAGCGAGCAAGGGGAGGCCATCCTGCCCCGCATCTCCGTGATCTCCACCGGGCCCACG
CFTR-C024 GACAGCGAGCAGGGGGAAGCCATCCTGCCAAGGATCTCCGTGATCAGCACCGGGCCCACC
CFTR-C049 GACAGCGAGCAGGGGGAAGCCATCCTGCCAAGGATCTCCGTGATCAGCACCGGGCCCACC
          **  ,**,**,** **,** ** **,** * **    ** **  *** ** ** **
```

FIG. 10 (cont)

| | |
|---|---|
| CFTR-WT | CTTCAGGCACGAAGGAGGCAGTCTGTCCTGAACCTGATGACACACTCAGTTAACCAAGGT |
| CFTR-C001 | CTGCAGGCCAGGCGCCGGCAAAGCGTGCTCAACCTGATGACCCACTCCGTCAACCAGGGC |
| CFTR-C026 | CTGCAGGCCAGGCGCCGGCAAAGCGTGCTCAACCTGATGACCCACTCCGTCAACCAGGGC |
| CFTR-C004 | CTGCAGGCCAGGAGGCGGCAGAGCGTGCTGAACCTGATGACCCATAGCGTGAACCAGGGC |
| CFTR-C029 | CTGCAGGCCAGGAGGCGGCAGAGCGTGCTGAACCTGATGACCCATAGCGTGAACCAGGGC |
| CFTR-C021 | CTGCAGGCCAGGCGGAGGCAGAGCGTGCTGAACCTGATGACGCACAGCGTGAACCAGGGC |
| CFTR-C046 | CTGCAGGCCAGGCGGAGGCAGAGCGTGCTGAACCTGATGACGCACAGCGTGAACCAGGGC |
| CFTR-C008 | CTGCAGGCCCGGCGGAGACAGTCCGTGCTGAATCTGATGACCCACTCCGTGAACCAGGGC |
| CFTR-C033 | CTGCAGGCCCGGCGGAGACAGTCCGTGCTGAATCTGATGACCCACTCCGTGAACCAGGGC |
| CFTR-C022 | CTGCAAGCCCGGCGGAGGCAAAGCGTGCTAAACCTCATGACCCACTCCGTGAACCAGGGG |
| CFTR-C047 | CTGCAAGCCCGGCGGAGGCAAAGCGTGCTAAACCTCATGACCCACTCCGTGAACCAGGGG |
| CFTR-C017 | CTGCAGGCCAGGAGGAGGCAGTCCGTGCTCAACTTGATGACCCACAGCGTCAACCAGGGG |
| CFTR-C042 | CTGCAGGCCAGGAGGAGGCAGTCCGTGCTCAACTTGATGACCCACAGCGTCAACCAGGGG |
| CFTR-C020 | CTGCAAGCCAGGCGGCGACAGAGCGTCCTGAACCTGATGACCCACAGCGTGAACCAGGGC |
| CFTR-C045 | CTGCAAGCCAGGCGGCGACAGAGCGTCCTGAACCTGATGACCCACAGCGTGAACCAGGGC |
| CFTR-C013 | CTGCAGGCCAGGCGTAGGCAGAGCGTGCTGAACCTCATGACCCATTCCGTGAATCAAGGT |
| CFTR-C038 | CTGCAGGCCAGGCGTAGGCAGAGCGTGCTGAACCTCATGACCCATTCCGTGAATCAAGGT |
| CFTR-C002 | CTGCAGGCAAGGAGGCGACAGAGTGTGCTGAATCTCATGACCCACAGTGTGAACCAGGGA |
| CFTR-C027 | CTGCAGGCAAGGAGGCGACAGAGTGTGCTGAATCTCATGACCCACAGTGTGAACCAGGGA |
| CFTR-C011 | CTGCAAGCGCGCAGGCGTCAAAGCGTCCTGAACCTGATGACCCACAGCGTGAACCAGGGC |
| CFTR-C036 | CTGCAAGCGCGCAGGCGTCAAAGCGTCCTGAACCTGATGACCCACAGCGTGAACCAGGGC |
| CFTR-C005 | CTGCAGGCCCGGAGGAGACAAAGTGTGCTGAACCTCATGACCCACAGCGTGAACCAGGGA |
| CFTR-C030 | CTGCAGGCCCGGAGGAGACAAAGTGTGCTGAACCTCATGACCCACAGCGTGAACCAGGGA |
| CFTR-C006 | CTGCAGGCCCGGAGGAGGCAAAGCGTGCTGAACCTCATGACCCACTCCGTGAACCAGGGT |
| CFTR-C031 | CTGCAGGCCCGGAGGAGGCAAAGCGTGCTGAACCTCATGACCCACTCCGTGAACCAGGGT |
| CFTR-C018 | CTGCAGGCCAGGCGGAGGCAGAGCGTGCTCAACCTGATGACCCACAGTGTGAATCAGGGC |
| CFTR-C043 | CTGCAGGCCAGGCGGAGGCAGAGCGTGCTCAACCTGATGACCCACAGTGTGAATCAGGGC |
| CFTR-C003 | CTCCAGGCCCGCAGGAGGCAGTCCGTGCTGAACCTGATGACCCACTCCGTAAATCAGGGG |
| CFTR-C028 | CTCCAGGCCCGCAGGAGGCAGTCCGTGCTGAACCTGATGACCCACTCCGTAAATCAGGGG |
| CFTR-C016 | CTGCAGGCCCGGAGGAGGCAGAGCGTCCTCAATCTGATGACGCACAGCGTCAATCAGGGC |
| CFTR-C041 | CTGCAGGCCCGGAGGAGGCAGAGCGTCCTCAATCTGATGACGCACAGCGTCAATCAGGGC |
| CFTR-C010 | CTGCAGGCCAGGAGGCGCCAAAGCGTGCTGAATCTGATGACTCACTCCGTAAACCAGGGC |
| CFTR-C035 | CTGCAGGCCAGGAGGCGCCAAAGCGTGCTGAATCTGATGACTCACTCCGTAAACCAGGGC |
| CFTR-C012 | CTGCAGGCCCGGAGGCGGCAGTCCGTGCTGAACCTCATGACTCACAGCGTGAACCAGGGA |
| CFTR-C037 | CTGCAGGCCCGGAGGCGGCAGTCCGTGCTGAACCTCATGACTCACAGCGTGAACCAGGGA |
| CFTR-C009 | CTGCAAGCCAGGCGTCGGCAATCCGTGCTGAACTTGATGACCCACTCCGTGAACCAGGGC |
| CFTR-C034 | CTGCAAGCCAGGCGTCGGCAATCCGTGCTGAACTTGATGACCCACTCCGTGAACCAGGGC |
| CFTR-C015 | CTGCAAGCGAGACGACGGCAGTCCGTGCTCAATCTGATGACCCACTCGGTCAACCAGGGC |
| CFTR-C040 | CTGCAAGCGAGACGACGGCAGTCCGTGCTCAATCTGATGACCCACTCGGTCAACCAGGGC |
| CFTR-C019 | CTGCAAGCCCGGCGGCGCCAGTCTGTGCTCAACCTCATGACCCATAGCGTGAACCAGGGC |
| CFTR-C044 | CTGCAAGCCCGGCGGCGCCAGTCTGTGCTCAACCTCATGACCCATAGCGTGAACCAGGGC |
| CFTR-C007 | CTGCAGGCCCGGCGCCGACAGAGCGTGCTGAACCTGATGACCCACAGCGTGAACCAGGGC |
| CFTR-C032 | CTGCAGGCCCGGCGCCGACAGAGCGTGCTGAACCTGATGACCCACAGCGTGAACCAGGGC |
| CFTR-C014 | CTGCAGGCGAGGAGGCGACAATCCGTACTGAATTGATGACGCACAGCGTGAACCAGGGC |
| CFTR-C039 | CTGCAGGCGAGGAGGCGACAATCCGTACTGAATTGATGACGCACAGCGTGAACCAGGGC |
| CFTR-C025 | CTGCAAGCCCGCAGGAGGCAGTCGGTGCTGAACCTCATGACGCACAGCGTGAATCAGGGC |
| CFTR-C050 | CTGCAAGCCCGCAGGAGGCAGTCGGTGCTGAACCTCATGACGCACAGCGTGAATCAGGGC |
| CFTR-C023 | CTGCAGGCCAGGCGGAGGCAGAGCGTGCTGAACCTGATGACCCACTCTGTGAACCAGGGC |
| CFTR-C048 | CTGCAGGCCAGGCGGAGGCAGAGCGTGCTGAACCTGATGACCCACTCTGTGAACCAGGGC |
| CFTR-C024 | CTGCAGGCCAGGCGGAGGCAATCGGTCCTCAATCTGATGACCCACAGCGTCAACCAAGGG |
| CFTR-C049 | CTGCAGGCCAGGCGGAGGCAATCGGTCCTCAATCTGATGACCCACAGCGTCAACCAAGGG |
| |  ,** * * * , .  ,,* *** , . ,, |

FIG. 10 (cont)

```
CFTR-WT   CAGAACATTCACCGAAAGACAACAGCATCCACACGAAAAGTGTCACTGGCCCCTCAGGCA
CFTR-C001 CAGAATATCCACCGCAAGACCACCGCCAGCACCAGGAAGGTGAGCCTGGCCCCGCAGGCC
CFTR-C026 CAGAATATCCACCGCAAGACCACCGCCAGCACCAGGAAGGTGAGCCTGGCCCCGCAGGCC
CFTR-C004 CAGAACATACACCGGAAGACGACCGCCAGCACCGGAAGGTCAGCCTGGCCCCCCAAGCC
CFTR-C029 CAGAACATACACCGGAAGACGACCGCCAGCACCGGAAGGTCAGCCTGGCCCCCCAAGCC
CFTR-C021 CAGAACATCCACAGGAAGACGACCGCCAGCACCCGGAAGGTGTCGCTCGCCCCCCAGGCC
CFTR-C046 CAGAACATCCACAGGAAGACGACCGCCAGCACCCGGAAGGTGTCGCTCGCCCCCCAGGCC
CFTR-C008 CAGAATATCCACAGAAAAACCACTGCCTCAACGAGGAAGGTGAGCCTGGCCCCCCAGGCG
CFTR-C033 CAGAATATCCACAGAAAAACCACTGCCTCAACGAGGAAGGTGAGCCTGGCCCCCCAGGCG
CFTR-C022 CAGAATATCCATCGGAAGACCACCGCCAGCACCCGGAAGGTGAGCCTGGCACCGCAGGCC
CFTR-C047 CAGAATATCCATCGGAAGACCACCGCCAGCACCCGGAAGGTGAGCCTGGCACCGCAGGCC
CFTR-C017 CAGAACATCCACAGGAAGACCACCGCCTCCACCAGGAAGGTGAGCCTCGCCCCGCAAGCC
CFTR-C042 CAGAACATCCACAGGAAGACCACCGCCTCCACCAGGAAGGTGAGCCTCGCCCCGCAAGCC
CFTR-C020 CAAAATATCCACAGGAAGACCACCGCAAGCACCCGCAAGGTCAGCCTGGCGCCCCAGGCC
CFTR-C045 CAAAATATCCACAGGAAGACCACCGCAAGCACCCGCAAGGTCAGCCTGGCGCCCCAGGCC
CFTR-C013 CAGAACATCCACCGCAAGACCACCGCCAGCACCAGGAAGGTCTCCCTGGCCCCCCAGGCC
CFTR-C038 CAGAACATCCACCGCAAGACCACCGCCAGCACCAGGAAGGTCTCCCTGGCCCCCCAGGCC
CFTR-C002 CAGAACATCCATCGCAAGACCACCGCCTCCACCCGTAAGGTGTCGCTGGCCCCCCAGGCC
CFTR-C027 CAGAACATCCATCGCAAGACCACCGCCTCCACCCGTAAGGTGTCGCTGGCCCCCCAGGCC
CFTR-C011 CAAAACATCCACCGCAAAACCACTGCCAGCACCCGGAAGGTGAGCCTGGCCCCGCAGGCA
CFTR-C036 CAAAACATCCACCGCAAAACCACTGCCAGCACCCGGAAGGTGAGCCTGGCCCCGCAGGCA
CFTR-C005 CAGAACATCCATAGGAAGACCACTGCGAGCACCCGGAAGGTGTCCCTGGCCCCCCAGGCA
CFTR-C030 CAGAACATCCATAGGAAGACCACTGCGAGCACCCGGAAGGTGTCCCTGGCCCCCCAGGCA
CFTR-C006 CAGAACATCCACAGGAAGACCACCGCCAGCACAAGGAAAGTGTCCCTGGCCCCCCAAGCC
CFTR-C031 CAGAACATCCACAGGAAGACCACCGCCAGCACAAGGAAAGTGTCCCTGGCCCCCCAAGCC
CFTR-C018 CAGAATATCCATCGCAAGACGACAGCCTCTACCCGAAAGGTCTCCCTGGCCCCCCAGGCC
CFTR-C043 CAGAATATCCATCGCAAGACGACAGCCTCTACCCGAAAGGTCTCCCTGGCCCCCCAGGCC
CFTR-C003 CAAAACATCCACCGGAAGACGACCGCCAGCACCCGAAAGGTGAGCCTGGCCCCCCAGGCC
CFTR-C028 CAAAACATCCACCGGAAGACGACCGCCAGCACCCGAAAGGTGAGCCTGGCCCCCCAGGCC
CFTR-C016 CAGAACATCCACCGAAAAACAACCGCCTCCACCCGCAAAGTGAGCCTGGCCCCCCAGGCT
CFTR-C041 CAGAACATCCACCGAAAAACAACCGCCTCCACCCGCAAAGTGAGCCTGGCCCCCCAGGCT
CFTR-C010 CAGAACATTCACAGGAAGACCACCGCCAGCACCCGAAAGGTGAGCCTGGCCCCCCAGGCC
CFTR-C035 CAGAACATTCACAGGAAGACCACCGCCAGCACCCGAAAGGTGAGCCTGGCCCCCCAGGCC
CFTR-C012 CAGAACATCCACAGGAAAACAACGGCCTCCACCCGCAAGGTCTCCCTGGCCCCCCAAGCC
CFTR-C037 CAGAACATCCACAGGAAAACAACGGCCTCCACCCGCAAGGTCTCCCTGGCCCCCCAAGCC
CFTR-C009 CAGAACATCCATAGGAAAACCACCGCCAGCACCCGGAAGGTGTCACTGGCCCCCCAGGCG
CFTR-C034 CAGAACATCCATAGGAAAACCACCGCCAGCACCCGGAAGGTGTCACTGGCCCCCCAGGCG
CFTR-C015 CAGAACATCCACAGGAAGACCACCGCCTCGACTAGGAAGGTCAGCCTCGCGCCCCAGGCC
CFTR-C040 CAGAACATCCACAGGAAGACCACCGCCTCGACTAGGAAGGTCAGCCTCGCGCCCCAGGCC
CFTR-C019 CAGAACATCCACCGCAAAACGACCGCCAGCACGCGTAAGGTGTCCCTGGCCCCGCAAGCC
CFTR-C044 CAGAACATCCACCGCAAAACGACCGCCAGCACGCGTAAGGTGTCCCTGGCCCCGCAAGCC
CFTR-C007 CAGAACATTCACCGGAAGACCACAGCCTCCACCCGTAAGGTGAGCCTGGCCCCGCAGGCC
CFTR-C032 CAGAACATTCACCGGAAGACCACAGCCTCCACCCGTAAGGTGAGCCTGGCCCCGCAGGCC
CFTR-C014 CAGAACATCCACCGTAAGACCACCGCCAGCACGCGCAAGGTGAGCCTCGCGCCCCAGGCC
CFTR-C039 CAGAACATCCACCGTAAGACCACCGCCAGCACGCGCAAGGTGAGCCTCGCGCCCCAGGCC
CFTR-C025 CAGAACATCCACAGGAAAACAACTGCGAGCACCCGCAAGGTGAGCCTGGCGCCCCAGGCC
CFTR-C050 CAGAACATCCACAGGAAAACAACTGCGAGCACCCGCAAGGTGAGCCTGGCGCCCCAGGCC
CFTR-C023 CAGAACATACACCGGAAGACCACCGCCTCGACCCGCAAGGTGAGTCTCGCCCCCCAGGCA
CFTR-C048 CAGAACATACACCGGAAGACCACCGCCTCGACCCGCAAGGTGAGTCTCGCCCCCCAGGCA
CFTR-C024 CAAAACATCCACCGGAAGACCACAGCGAGCACCCGAAAGGTGTCCCTGGCCCCCCAGGCC
CFTR-C049 CAAAACATCCACCGGAAGACCACAGCGAGCACCCGAAAGGTGTCCCTGGCCCCCCAGGCC
          ** ** ** **  * ** **  **       **  * ** **    ** ** ** ** **
```

FIG. 10 (cont)

```
CFTR-WT    AACTTGACTGAACTGGATATATATTCAAGAAGGTTATCTCAAGAAACTGGCTTGGAAATA
CFTR-C001  AACCTAACCGAGCTGGACATCTACTCCCGGCGGCTGAGCCAGGAAACGGGCCTGGAGATC
CFTR-C026  AACCTAACCGAGCTGGACATCTACTCCCGGCGGCTGAGCCAGGAAACGGGCCTGGAGATC
CFTR-C004  AACCTGACCGAGCTGGACATCTACAGCAGGCGTCTGAGCCAGGAGACCGGGCTGGAGATC
CFTR-C029  AACCTGACCGAGCTGGACATCTACAGCAGGCGTCTGAGCCAGGAGACCGGGCTGGAGATC
CFTR-C021  AATCTGACCGAGCTGGACATCTACAGCCGGCGGCTGTCGCAGGAGACGGGGCTGGAGATC
CFTR-C046  AATCTGACCGAGCTGGACATCTACAGCCGGCGGCTGTCGCAGGAGACGGGGCTGGAGATC
CFTR-C008  AACCTGACCGAGCTGGACATCTACAGCCGGAGGCTGAGCCAAGAGACCGGCCTGGAGATC
CFTR-C033  AACCTGACCGAGCTGGACATCTACAGCCGGAGGCTGAGCCAAGAGACCGGCCTGGAGATC
CFTR-C022  AACCTGACCGAGCTGGATATCTACAGCCGACGGCTGAGCCAGGAAACCGGACTCGAGATC
CFTR-C047  AACCTGACCGAGCTGGATATCTACAGCCGACGGCTGAGCCAGGAAACCGGACTCGAGATC
CFTR-C017  AACCTCACCGAGCTGGACATCTACTCCAGGAGGCTGAGCCAGGAGACCGGCCTGGAAATC
CFTR-C042  AACCTCACCGAGCTGGACATCTACTCCAGGAGGCTGAGCCAGGAGACCGGCCTGGAAATC
CFTR-C020  AACCTGACGGAGCTCGACATCTATTCCAGGCGGCTGAGCCAGGAGACCGGCCTGGAGATC
CFTR-C045  AACCTGACGGAGCTCGACATCTATTCCAGGCGGCTGAGCCAGGAGACCGGCCTGGAGATC
CFTR-C013  AATCTCACCGAGCTGGATATCTACAGCAGGCGCCTGAGCCAGGAGACCGGCCTGGAGATC
CFTR-C038  AATCTCACCGAGCTGGATATCTACAGCAGGCGCCTGAGCCAGGAGACCGGCCTGGAGATC
CFTR-C002  AACCTCACGGAACTGGATATCTACTCTCGAAGGCTGAGCCAGGAGACCGGTCTCGAAATC
CFTR-C027  AACCTCACGGAACTGGATATCTACTCTCGAAGGCTGAGCCAGGAGACCGGTCTCGAAATC
CFTR-C011  AATCTGACCGAACTGGACATCTACAGCCGCAGGCTGAGCCAGGAAACGGGTCTCGAGATC
CFTR-C036  AATCTGACCGAACTGGACATCTACAGCCGCAGGCTGAGCCAGGAAACGGGTCTCGAGATC
CFTR-C005  AACCTGACCGAGCTGGACATCTACTCCCGGCGCCTGAGCCAGGAAACCGGGCTGGAGATA
CFTR-C030  AACCTGACCGAGCTGGACATCTACTCCCGGCGCCTGAGCCAGGAAACCGGGCTGGAGATA
CFTR-C006  AACCTTACCGAGCTGGACATCTATTCCAGGAGGCTCAGCCAGGAGACCGGGCTAGAAATC
CFTR-C031  AACCTTACCGAGCTGGACATCTATTCCAGGAGGCTCAGCCAGGAGACCGGGCTAGAAATC
CFTR-C018  AACCTGACCGAGCTGGACATATACTCCAGGCGTCTGAGCCAGGAGACTGGGCTGGAGATC
CFTR-C043  AACCTGACCGAGCTGGACATATACTCCAGGCGTCTGAGCCAGGAGACTGGGCTGGAGATC
CFTR-C003  AACCTGACCGAGCTCGACATTTATAGCAGGAGGCTGTCCCAGGAGACTGGCCTCGAGATT
CFTR-C028  AACCTGACCGAGCTCGACATTTATAGCAGGAGGCTGTCCCAGGAGACTGGCCTCGAGATT
CFTR-C016  AATCTGACAGAGCTCGACATATACTCCGGAGGCTGAGCCAAGAGACCGGCCTGGAGATC
CFTR-C041  AATCTGACAGAGCTCGACATATACTCCCGGAGGCTGAGCCAAGAGACCGGCCTGGAGATC
CFTR-C010  AACCTGACCGAGCTGGACATCTACAGCCGGCGCCTGAGCCAGGAGACAGGACTGGAGATC
CFTR-C035  AACCTGACCGAGCTGGACATCTACAGCCGGCGCCTGAGCCAGGAGACAGGACTGGAGATC
CFTR-C012  AACCTGACCGAGCTGGACATCTACTCGAGGAGGCTGAGCCAGGAGACCGGCCTGGAGATC
CFTR-C037  AACCTGACCGAGCTGGACATCTACTCGAGGAGGCTGAGCCAGGAGACCGGCCTGGAGATC
CFTR-C009  AACCTTACGGAGCTGGACATCTACAGCCGACGGCTTAGCCAAGAGACCGGCCTGGAGATC
CFTR-C034  AACCTTACGGAGCTGGACATCTACAGCCGACGGCTTAGCCAAGAGACCGGCCTGGAGATC
CFTR-C015  AACCTGACCGAGCTGGACATTTACAGCCGAAGGCTGTCGCAGGAGACCGGTCTCGAAATA
CFTR-C040  AACCTGACCGAGCTGGACATTTACAGCCGAAGGCTGTCGCAGGAGACCGGTCTCGAAATA
CFTR-C019  AACCTCACCGAGCTGGACATCTACTCCCGAAGGCTGAGCCAGGAGACAGGTCTGGAGATC
CFTR-C044  AACCTCACCGAGCTGGACATCTACTCCCGAAGGCTGAGCCAGGAGACAGGTCTGGAGATC
CFTR-C007  AACCTGACCGAGCTGGACATCTACAGCCGAAGGCTGTCGCAGGAGACCGGGCTGGAAATC
CFTR-C032  AACCTGACCGAGCTGGACATCTACAGCCGAAGGCTGTCGCAGGAGACCGGGCTGGAAATC
CFTR-C014  AACCTGACCGAGCTGGACATCTACAGCAGGCGGCTTTCCCAGGAGACCGGCCTGGAGATC
CFTR-C039  AACCTGACCGAGCTGGACATCTACAGCAGGCGGCTTTCCCAGGAGACCGGCCTGGAGATC
CFTR-C025  AACCTGACCGAGCTCGACATCTATAGCCGTCGGCTGAGCCAGGAGACCGGCCTGGAGATC
CFTR-C050  AACCTGACCGAGCTCGACATCTATAGCCGTCGGCTGAGCCAGGAGACCGGCCTGGAGATC
CFTR-C023  AACCTCACCGAGCTAGATATCTATAGCAGGAGGCTGAGCCAGGAGACGGGCCTCGAGATC
CFTR-C048  AACCTCACCGAGCTAGATATCTATAGCAGGAGGCTGAGCCAGGAGACGGGCCTCGAGATC
CFTR-C024  AACCTGACCGAGCTGGACATCTACAGCCGCAGGCTGAGCCAGGAGACCGGCCTGGAGATC
CFTR-C049  AACCTGACCGAGCTGGACATCTACAGCCGCAGGCTGAGCCAGGAGACCGGCCTGGAGATC
           **,,* ** **,** **,**  **,      *   *,*   **,**,** ** ,* **,**
```

FIG. 10 (cont)

```
CFTR-WT    AGTGAAGAAATTAACGAAGAAGACTTAAAGGAGTGCTTTTTTGATGATATGGAGAGCATA
CFTR-CO01  AGCGAAGAGATCAACGAGGAGGACCTGAAGGAGTGTTTCTTCGACGATATGGAGAGCATC
CFTR-CO26  AGCGAAGAGATCAACGAGGAGGACCTGAAGGAGTGTTTCTTCGACGATATGGAGAGCATC
CFTR-CO04  AGCGAAGAGATCAACGAGGAGGACCTGAAGGAGTGCTTTTTTGACGACATGGAGAGCATC
CFTR-CO29  AGCGAAGAGATCAACGAGGAGGACCTGAAGGAGTGCTTTTTTGACGACATGGAGAGCATC
CFTR-CO21  AGCGAGGAGATCAACGAGGAGGACCTGAAGGAGTGCTTCTTCGACGACATGGAGTCCATC
CFTR-CO46  AGCGAGGAGATCAACGAGGAGGACCTGAAGGAGTGCTTCTTCGACGACATGGAGTCCATC
CFTR-CO08  TCCGAGGAGATCAACGAGGAGGATCTCAAGGAGTGCTTCTTCGACGACATGGAGAGCATC
CFTR-CO33  TCCGAGGAGATCAACGAGGAGGATCTCAAGGAGTGCTTCTTCGACGACATGGAGAGCATC
CFTR-CO22  AGCGAGGAGATCAACGAGGAGGACCTGAAGGAGTGCTTCTTCGACGACATGGAGAGCATC
CFTR-CO47  AGCGAGGAGATCAACGAGGAGGACCTGAAGGAGTGCTTCTTCGACGACATGGAGAGCATC
CFTR-CO17  TCCGAGGAGATCAACGAGGAGGACCTGAAGGAGTGTTTCTTCGACGACATGGAGAGCATC
CFTR-CO42  TCCGAGGAGATCAACGAGGAGGACCTGAAGGAGTGTTTCTTCGACGACATGGAGAGCATC
CFTR-CO20  TCCGAGGAGATCAATGAGGAGGACCTGAAAGAATGCTTCTTCGACGACATGGAGAGCATC
CFTR-CO45  TCCGAGGAGATCAATGAGGAGGACCTGAAAGAATGCTTCTTCGACGACATGGAGAGCATC
CFTR-CO13  AGCGAGGAGATCAACGAGGAGGACCTGAAGGAGTGCTTCTTCGACGACATGGAGAGCATA
CFTR-CO38  AGCGAGGAGATCAACGAGGAGGACCTGAAGGAGTGCTTCTTCGACGACATGGAGAGCATA
CFTR-CO02  TCCGAGGAGATTAACGAGGAGGACCTCAAGGAGTGTTTTTTCGATGATATGGAGTCCATC
CFTR-CO27  TCCGAGGAGATTAACGAGGAGGACCTCAAGGAGTGTTTTTTCGATGATATGGAGTCCATC
CFTR-CO11  AGCGAGGAGATCAACGAGGAGGACCTGAAAGAATGCTTTTTCGACGACATGGAGTCCATT
CFTR-CO36  AGCGAGGAGATCAACGAGGAGGACCTGAAAGAATGCTTTTTCGACGACATGGAGTCCATT
CFTR-CO05  AGCGAGGAGATCAATGAGGAGGATCTGAAGGAGTGTTTCTTCGACGACATGGAGTCGATC
CFTR-CO30  AGCGAGGAGATCAATGAGGAGGATCTGAAGGAGTGTTTCTTCGACGACATGGAGTCGATC
CFTR-CO06  AGCGAGGAAATCAACGAGGAGGACCTGAAGGAGTGCTTCTTCGACGACATGGAGTCAATC
CFTR-CO31  AGCGAGGAAATCAACGAGGAGGACCTGAAGGAGTGCTTCTTCGACGACATGGAGTCAATC
CFTR-CO18  TCCGAGGAGATAAACGAGGAAGACCTGAAGGAGTGCTTTTTCGACGACATGGAGTCCATT
CFTR-CO43  TCCGAGGAGATAAACGAGGAAGACCTGAAGGAGTGCTTTTTCGACGACATGGAGTCCATT
CFTR-CO03  TCCGAGGAAATCAACGAGGAAGACCTGAAGGAGTGCTTCTTTGATGACATGGAGTCGATC
CFTR-CO28  TCCGAGGAAATCAACGAGGAAGACCTGAAGGAGTGCTTCTTTGATGACATGGAGTCGATC
CFTR-CO16  TCCGAAGAGATTAATGAGGAGGACCTGAAGGAGTGCTTTTTCGACGACATGGAGTCCATC
CFTR-CO41  TCCGAAGAGATTAATGAGGAGGACCTGAAGGAGTGCTTTTTCGACGACATGGAGTCCATC
CFTR-CO10  AGCGAAGAGATCAACGAAGAGGACCTCAAGGAGTGCTTCTTCGACGACATGGAGAGCATC
CFTR-CO35  AGCGAAGAGATCAACGAAGAGGACCTCAAGGAGTGCTTCTTCGACGACATGGAGAGCATC
CFTR-CO12  AGCGAGGAGATCAACGAAGAGGACCTGAAGGAGTGCTTCTTTGACGATATGGAGTCCATC
CFTR-CO37  AGCGAGGAGATCAACGAAGAGGACCTGAAGGAGTGCTTCTTTGACGATATGGAGTCCATC
CFTR-CO09  AGCGAAGAGATCAACGAGGAGGATCTGAAAGAGTGCTTCTTTGATGACATGGAAAGCATC
CFTR-CO34  AGCGAAGAGATCAACGAGGAGGATCTGAAAGAGTGCTTCTTTGATGACATGGAAAGCATC
CFTR-CO15  TCTGAGGAGATCAACGAGGAGGATCTGAAGGAGTGCTTCTTCGACGACATGGAGAGCATC
CFTR-CO40  TCTGAGGAGATCAACGAGGAGGATCTGAAGGAGTGCTTCTTCGACGACATGGAGAGCATC
CFTR-CO19  TCGGAGGAGATCAATGAAGAGGACCTTAAGGAGTGCTTCTTCGACGACATGGAAAGCATC
CFTR-CO44  TCGGAGGAGATCAATGAAGAGGACCTTAAGGAGTGCTTCTTCGACGACATGGAAAGCATC
CFTR-CO07  TCCGAGGAGATCAACGAGGAGGACCTCAAGGAGTGTTTCTTCGACGATATGGAGAGCATC
CFTR-CO32  TCCGAGGAGATCAACGAGGAGGACCTCAAGGAGTGTTTCTTCGACGATATGGAGAGCATC
CFTR-CO14  TCCGAGGAGATCAACGAGGAGGACCTGAAGGAGTGCTTTTTCGACGACATGGAGAGCATC
CFTR-CO39  TCCGAGGAGATCAACGAGGAGGACCTGAAGGAGTGCTTTTTCGACGACATGGAGAGCATC
CFTR-CO25  AGCGAGGAGATTAATGAGGAGGACCTCAAGGAATGCTTCTTCGACGACATGGAGAGCATC
CFTR-CO50  AGCGAGGAGATTAATGAGGAGGACCTCAAGGAATGCTTCTTCGACGACATGGAGAGCATC
CFTR-CO23  AGCGAGGAAATAAATGAAGAGGACCTGAAGGAGTGCTTCTTCGACGATATGGAGAGCATA
CFTR-CO48  AGCGAGGAAATAAATGAAGAGGACCTGAAGGAGTGCTTCTTCGACGATATGGAGAGCATA
CFTR-CO24  AGCGAGGAGATCAACGAGGAGGACCTGAAGGAGTGCTTTTTGACGATATGGAGAGCATC
CFTR-CO49  AGCGAGGAGATCAACGAGGAGGACCTGAAGGAGTGCTTTTTGACGATATGGAGAGCATC
           **,**,** **,**,**,**,*  **,**,**,**,**,**,**,*****,  **
```

FIG. 10 (cont)

```
CFTR-WT    CCAGCAGTGACTACATGGAACACATACCTTCGATATATTACTGTCCACAAGAGCTTAATT
CFTR-C001  CCCGCCGTGACCACCTGGAACACCTATCTGCGGTATATCACCGTGCATAAGTCCTTAATC
CFTR-C026  CCCGCCGTGACCACCTGGAACACCTATCTGCGGTATATCACCGTGCATAAGTCCTTAATC
CFTR-C004  CCCGCCGTGACCACCTGGAACACCTACCTGCGCTACATCACCGTCCACAAGTCCCTCATA
CFTR-C029  CCCGCCGTGACCACCTGGAACACCTACCTGCGCTACATCACCGTCCACAAGTCCCTCATA
CFTR-C021  CCCGCCGTCACCACGTGGAACACCTACCTTAGGTACATCACCGTGCACAAATCCCTGATA
CFTR-C046  CCCGCCGTCACCACGTGGAACACCTACCTTAGGTACATCACCGTGCACAAATCCCTGATA
CFTR-C008  CCCGCCGTGACCACCTGGAACACCTACCTGAGGTACATTACCGTGCACAAGTCCCTGATC
CFTR-C033  CCCGCCGTGACCACCTGGAACACCTACCTGAGGTACATTACCGTGCACAAGTCCCTGATC
CFTR-C022  CCCGCCGTTACCACCTGGAACACCTACCTGCGCTACATCACCGTGCACAAAAGCCTGATC
CFTR-C047  CCCGCCGTTACCACCTGGAACACCTACCTGCGCTACATCACCGTGCACAAAAGCCTGATC
CFTR-C017  CCCGCCGTGACGACCTGGAACACCTACCTGAGGTACATCACCGTCCACAAGTCCCTGATC
CFTR-C042  CCCGCCGTGACGACCTGGAACACCTACCTGAGGTACATCACCGTCCACAAGTCCCTGATC
CFTR-C020  CCCGCCGTGACGACCTGGAATACCTACCTCCGTTATATCACCGTGCACAAGAGCCTGATC
CFTR-C045  CCCGCCGTGACGACCTGGAATACCTACCTCCGTTATATCACCGTGCACAAGAGCCTGATC
CFTR-C013  CCCGCCGTGACCACCTGGAACACGTACCTCCGGTATATCACCGTCCACAAATCCCTGATC
CFTR-C038  CCCGCCGTGACCACCTGGAACACGTACCTCCGGTATATCACCGTCCACAAATCCCTGATC
CFTR-C002  CCCGCCGTGACCACCTGGAACACCTATCTGCGTTATATCACCGTGCACAAGAGCCTGATC
CFTR-C027  CCCGCCGTGACCACCTGGAACACCTATCTGCGTTATATCACCGTGCACAAGAGCCTGATC
CFTR-C011  CCCGCCGTGACCACCTGGAACACCTACCTGAGGTATATCACCGTGCACAAGAGCCTGATC
CFTR-C036  CCCGCCGTGACCACCTGGAACACCTACCTGAGGTATATCACCGTGCACAAGAGCCTGATC
CFTR-C005  CCCGCCGTGACCACCTGGAACACGTATCTGCGCTACATCACCGTGCACAAGAGCCTGATC
CFTR-C030  CCCGCCGTGACCACCTGGAACACGTATCTGCGCTACATCACCGTGCACAAGAGCCTGATC
CFTR-C006  CCCGCCGTGACCACCTGGAACACCTACCTGAGGTACATCACCGTGCACAAGAGCCTGATC
CFTR-C031  CCCGCCGTGACCACCTGGAACACCTACCTGAGGTACATCACCGTGCACAAGAGCCTGATC
CFTR-C018  CCCGCGGTCACGACCTGGAACACCTACCTCCGCTACATCACGGTGCATAAAAGCCTGATC
CFTR-C043  CCCGCGGTCACGACCTGGAACACCTACCTCCGCTACATCACGGTGCATAAAAGCCTGATC
CFTR-C003  CCCGCCGTGACCACCTGGAACACATACCTGAGGTACATCACCGTGCACAAAAGCCTGATC
CFTR-C028  CCCGCCGTGACCACCTGGAACACATACCTGAGGTACATCACCGTGCACAAAAGCCTGATC
CFTR-C016  CCTGCCGTGACCACCTGGAACACCTACCTGCGGTATATCACCGTGCACAAGTCCTTGATC
CFTR-C041  CCTGCCGTGACCACCTGGAACACCTACCTGCGGTATATCACCGTGCACAAGTCCTTGATC
CFTR-C010  CCCGCCGTAACCACCTGGAACACCTATCTGAGGTACATCACGGTGCACAAGAGCCTCATC
CFTR-C035  CCCGCCGTAACCACCTGGAACACCTATCTGAGGTACATCACGGTGCACAAGAGCCTCATC
CFTR-C012  CCCGCGGTGACGACGTGGAATACCTACCTTAGGTACATCACCGTGCATAAGAGCCTGATC
CFTR-C037  CCCGCGGTGACGACGTGGAATACCTACCTTAGGTACATCACCGTGCATAAGAGCCTGATC
CFTR-C009  CCCGCCGTGACTACCTGGAATACCTATCTGCGTTATATCACCGTCCACAAATCCCTGATC
CFTR-C034  CCCGCCGTGACTACCTGGAATACCTATCTGCGTTATATCACCGTCCACAAATCCCTGATC
CFTR-C015  CCCGCCGTCACCACCTGGAACACCTACCTGCGGTATATCACGGTGCACAAGAGCCTGATC
CFTR-C040  CCCGCCGTCACCACCTGGAACACCTACCTGCGGTATATCACGGTGCACAAGAGCCTGATC
CFTR-C019  CCCGCCGTGACCACGTGGAACACCTACCTGAGGTACATCACCGTGCACAAGAGCCTGATC
CFTR-C044  CCCGCCGTGACCACGTGGAACACCTACCTGAGGTACATCACCGTGCACAAGAGCCTGATC
CFTR-C007  CCCGCCGTGACCACCTGGAACACCTACCTACGCTATATCACAGTGCATAAGTCCCTGATC
CFTR-C032  CCCGCCGTGACCACCTGGAACACCTACCTACGCTATATCACAGTGCATAAGTCCCTGATC
CFTR-C014  CCCGCCGTGACCACCTGGAACACCTACCTCAGGTACATCACCGTGCACAAGAGCCTGATC
CFTR-C039  CCCGCCGTGACCACCTGGAACACCTACCTCAGGTACATCACCGTGCACAAGAGCCTGATC
CFTR-C025  CCCGCGGTGACCACCTGGAACACCTATCTGAGGTACATAACCGTGCACAAATCCCTGATC
CFTR-C050  CCCGCGGTGACCACCTGGAACACCTATCTGAGGTACATAACCGTGCACAAATCCCTGATC
CFTR-C023  CCGGCCGTGACGACCTGGAATACCTACCTGAGGTACATCACCGTGCACAAATCGCTGATC
CFTR-C048  CCGGCCGTGACGACCTGGAATACCTACCTGAGGTACATCACCGTGCACAAATCGCTGATC
CFTR-C024  CCTGCCGTGACCACCTGGAACACCTACTTGCGTTACATAACCGTGCACAAGAGCCTGATC
CFTR-C049  CCTGCCGTGACCACCTGGAACACCTACTTGCGTTACATAACCGTGCACAAGAGCCTGATC
           ** ** ** ** ** *****.** **..*  * **.** ** ** **.**.   .* **
```

FIG. 10 (cont)

| | |
|---|---|
| CFTR-WT | TTTGTGCTAATTTGGTGCTTAGTAATTTTTCTGGCAGAGGTGGCTGCTTCTTTGGTTGTG |
| CFTR-C001 | TTCGTGCTGATCTGGTGCCTGGTGATCTTCCTGGCGGAGGTGGCCGCCAGCCTGGTGGTG |
| CFTR-C026 | TTCGTGCTGATCTGGTGCCTGGTGATCTTCCTGGCGGAGGTGGCCGCCAGCCTGGTGGTG |
| CFTR-C004 | TTCGTCCTGATCTGGTGCCTGGTCATCTTCCTCGCAGAAGTGGCCGCCAGCCTGGTGGTG |
| CFTR-C029 | TTCGTCCTGATCTGGTGCCTGGTCATCTTCCTCGCAGAAGTGGCCGCCAGCCTGGTGGTG |
| CFTR-C021 | TTCGTGCTGATCTGGTGCTTGGTGATCTTCCTCGCCGAGGTGGCCGCCAGCCTGGTGGTC |
| CFTR-C046 | TTCGTGCTGATCTGGTGCTTGGTGATCTTCCTCGCCGAGGTGGCCGCCAGCCTGGTGGTC |
| CFTR-C008 | TTCGTGCTGATCTGGTGCCTGGTCATCTTCCTGGCCGAGGTGGCCGCCAGCCTCGTGGTA |
| CFTR-C033 | TTCGTGCTGATCTGGTGCCTGGTCATCTTCCTGGCCGAGGTGGCCGCCAGCCTCGTGGTA |
| CFTR-C022 | TTTGTGCTGATATGGTGCCTGGTGATCTTTCTGGCCGAGGTGGCCGCCAGCCTGGTGGTG |
| CFTR-C047 | TTTGTGCTGATATGGTGCCTGGTGATCTTTCTGGCCGAGGTGGCCGCCAGCCTGGTGGTG |
| CFTR-C017 | TTTGTGCTCATCTGGTGTCTGGTCATCTTTCTTGCGGAGGTGGCCGCAAGCCTGGTCGTG |
| CFTR-C042 | TTTGTGCTCATCTGGTGTCTGGTCATCTTTCTTGCGGAGGTGGCCGCAAGCCTGGTCGTG |
| CFTR-C020 | TTCGTGCTGATCTGGTGCCTGGTGATCTTCCTGGCCGAGGTCGCCGCATCGCTGGTGGTG |
| CFTR-C045 | TTCGTGCTGATCTGGTGCCTGGTGATCTTCCTGGCCGAGGTCGCCGCATCGCTGGTGGTG |
| CFTR-C013 | TTCGTGCTGATCTGGTGCCTGGTGATCTTCCTGGCCGAGGTGGCCGCCAGCCTGGTGGTG |
| CFTR-C038 | TTCGTGCTGATCTGGTGCCTGGTGATCTTCCTGGCCGAGGTGGCCGCCAGCCTGGTGGTG |
| CFTR-C002 | TTCGTGCTGATATGGTGCCTGGTGATCTTCCTCGCCGAGGTGGCCGCCTCCCTGGTCGTG |
| CFTR-C027 | TTCGTGCTGATATGGTGCCTGGTGATCTTCCTCGCCGAGGTGGCCGCCTCCCTGGTCGTG |
| CFTR-C011 | TTCGTGCTGATCTGGTGCCTGGTGATCTTTCTGGCCGAAGTGGCTGCCAGCCTGGTGGTG |
| CFTR-C036 | TTCGTGCTGATCTGGTGCCTGGTGATCTTTCTGGCCGAAGTGGCTGCCAGCCTGGTGGTG |
| CFTR-C005 | TTCGTGCTCATCTGGTGCTTGGTGATCTTTCTGGCCGAAGTCGCCGCCTCCCTGGTGGTG |
| CFTR-C030 | TTCGTGCTCATCTGGTGCTTGGTGATCTTTCTGGCCGAAGTCGCCGCCTCCCTGGTGGTG |
| CFTR-C006 | TTCGTGCTGATCTGGTGTCTGGTCATCTTCCTGGCCGAGGTGGCCGCCAGCCTGGTCGTC |
| CFTR-C031 | TTCGTGCTGATCTGGTGTCTGGTCATCTTCCTGGCCGAGGTGGCCGCCAGCCTGGTCGTC |
| CFTR-C018 | TTCGTGCTCATCTGGTGTCTGGTGATCTTCCTGGCCGAAGTGGCCGCGAGCCTGGTGGTG |
| CFTR-C043 | TTCGTGCTCATCTGGTGTCTGGTGATCTTCCTGGCCGAAGTGGCCGCGAGCCTGGTGGTG |
| CFTR-C003 | TTCGTACTCATCTGGTGCCTGGTGATCTTTCTCGCCGAGGTGGCCGCCTCGCTGGTGGTC |
| CFTR-C028 | TTCGTACTCATCTGGTGCCTGGTGATCTTTCTCGCCGAGGTGGCCGCCTCGCTGGTGGTC |
| CFTR-C016 | TTCGTCCTGATCTGGTGCTTGGTGATCTTCCTGGCTGAGGTGGCCGCCTCCCTGGTGGTG |
| CFTR-C041 | TTCGTCCTGATCTGGTGCTTGGTGATCTTCCTGGCTGAGGTGGCCGCCTCCCTGGTGGTG |
| CFTR-C010 | TTCGTGCTCATCTGGTGTCTGGTCATCTTCCTGGCAGAGGTCGCCGCGAGCCTGGTGGTC |
| CFTR-C035 | TTCGTGCTCATCTGGTGTCTGGTCATCTTCCTGGCAGAGGTCGCCGCGAGCCTGGTGGTC |
| CFTR-C012 | TTCGTGCTGATCTGGTGCCTGGTGATCTTCCTGGCCGAGGTGGCCGCATCCCTGGTGGTG |
| CFTR-C037 | TTCGTGCTGATCTGGTGCCTGGTGATCTTCCTGGCCGAGGTGGCCGCATCCCTGGTGGTG |
| CFTR-C009 | TTCGTGCTGATCTGGTGCCTGGTGATCTTTCTGGCTGAAGTGGCCGCCTCCCTGGTGGTG |
| CFTR-C034 | TTCGTGCTGATCTGGTGCCTGGTGATCTTTCTGGCTGAAGTGGCCGCCTCCCTGGTGGTG |
| CFTR-C015 | TTCGTGCTGATCTGGTGCCTGGTGATCTTCCTAGCCGAGGTCGCCGCCTCCCTCGTGGTG |
| CFTR-C040 | TTCGTGCTGATCTGGTGCCTGGTGATCTTCCTAGCCGAGGTCGCCGCCTCCCTCGTGGTG |
| CFTR-C019 | TTCGTGCTGATCTGGTGCCTGGTGATCTTCCTGGCCGAGGTGGCGGCCAGCCTGGTGGTG |
| CFTR-C044 | TTCGTGCTGATCTGGTGCCTGGTGATCTTCCTGGCCGAGGTGGCGGCCAGCCTGGTGGTG |
| CFTR-C007 | TTCGTGCTCATCTGGTGCCTCGTGATATTCTGGCCGAGGTCGCCGCCAGCCTGGTAGTG |
| CFTR-C032 | TTCGTGCTCATCTGGTGCCTCGTGATATTCTGGCCGAGGTCGCCGCCAGCCTGGTAGTG |
| CFTR-C014 | TTTGTCCTGATCTGGTGCCTCGTGATCTTCCTCGCCGAGGTGGCCGCCTCCCTGGTGGTG |
| CFTR-C039 | TTTGTCCTGATCTGGTGCCTCGTGATCTTCCTCGCCGAGGTGGCCGCCTCCCTGGTGGTG |
| CFTR-C025 | TTCGTCCTGATCTGGTGCCTGGTGATCTTCCTCGCCGAGGTCGCCGCGAGCCTCGTCGTG |
| CFTR-C050 | TTCGTCCTGATCTGGTGCCTGGTGATCTTCCTCGCCGAGGTCGCCGCGAGCCTCGTCGTG |
| CFTR-C023 | TTCGTGCTGATTTGGTGCCTGGTAATCTTCCTGGCTGAGGTGGCCGCCTCCCTCGTGGTG |
| CFTR-C048 | TTCGTGCTGATTTGGTGCCTGGTAATCTTCCTGGCTGAGGTGGCCGCCTCCCTCGTGGTG |
| CFTR-C024 | TTCGTCCTGATCTGGTGCCTGGTGATCTTCCTGGCCGAGGTGGCCGCCAGCCTCGTGGTC |
| CFTR-C049 | TTCGTCCTGATCTGGTGCCTGGTGATCTTCCTGGCCGAGGTGGCCGCCAGCCTCGTGGTC |

FIG. 10 (cont)

```
CFTR-WT    CTGTGGCTCCTTGGAAACACTCCTCTTCAAGACAAAGGGAATAGTACTCATAGTAGAAAT
CFTR-C001  CTGTGGCTGCTGGGGAACACGCCCCTGCAGGATAAGGGCAACAGCACCCACAGCAGGAAC
CFTR-C026  CTGTGGCTGCTGGGGAACACGCCCCTGCAGGATAAGGGCAACAGCACCCACAGCAGGAAC
CFTR-C004  CTGTGGCTGCTGGGCAACACCCCGCTGCAAGACAAGGGAAACAGCACCCACAGCAGGAAC
CFTR-C029  CTGTGGCTGCTGGGCAACACCCCGCTGCAAGACAAGGGAAACAGCACCCACAGCAGGAAC
CFTR-C021  CTGTGGCTCCTGGGCAACACCCCACTGCAGGATAAGGGCAACAGCACCCACTCCCGCAAC
CFTR-C046  CTGTGGCTCCTGGGCAACACCCCACTGCAGGATAAGGGCAACAGCACCCACTCCCGCAAC
CFTR-C008  CTGTGGCTGCTGGGCAACACCCCCTGCAGGACAAGGGCAACAGCACCCACAGTCGGAAC
CFTR-C033  CTGTGGCTGCTGGGCAACACCCCCTGCAGGACAAGGGCAACAGCACCCACAGTCGGAAC
CFTR-C022  CTGTGGCTACTGGGCAATACCCCCTGCAGGATAAGGGCAACAGCACCCACAGCAGGAAC
CFTR-C047  CTGTGGCTACTGGGCAATACCCCCTGCAGGATAAGGGCAACAGCACCCACAGCAGGAAC
CFTR-C017  CTGTGGCTGCTGGGAAACACCCCACTGCAGGACAAGGGTAACAGCACCCACAGCAGGAAC
CFTR-C042  CTGTGGCTGCTGGGAAACACCCCACTGCAGGACAAGGGTAACAGCACCCACAGCAGGAAC
CFTR-C020  CTGTGGCTGCTGGGGAACACCCCGCTGCAGGACAAGGGCAACTCCACCCACAGCAGGAAC
CFTR-C045  CTGTGGCTGCTGGGGAACACCCCGCTGCAGGACAAGGGCAACTCCACCCACAGCAGGAAC
CFTR-C013  CTCTGGCTGTTGGGCAACACACCCCTGCAGGACAAGGGCAACAGCACGCATTCCCGGAAC
CFTR-C038  CTCTGGCTGTTGGGCAACACACCCCTGCAGGACAAGGGCAACAGCACGCATTCCCGGAAC
CFTR-C002  CTCTGGCTGCTGGGTAACACCCCCTGCAAGACAAGGGCAACTCCACACACAGCCGGAAC
CFTR-C027  CTCTGGCTGCTGGGTAACACCCCCTGCAAGACAAGGGCAACTCCACACACAGCCGGAAC
CFTR-C011  CTGTGGCTCCTGGGCAATACCCCCCTGCAAGACAAGGGCAACTCCACCCACTCCCGGAAC
CFTR-C036  CTGTGGCTCCTGGGCAATACCCCCTGCAAGACAAGGGCAACTCCACCCACTCCCGGAAC
CFTR-C005  CTGTGGCTGCTCGGTAACACCCCCCTGCAGGACAAGGGGAACAGCACCCACAGCCGTAAC
CFTR-C030  CTGTGGCTGCTCGGTAACACCCCCCTGCAGGACAAGGGGAACAGCACCCACAGCCGTAAC
CFTR-C006  CTCTGGCTGCTGGGGAACACCCCCCTCCAGGATAAGGGGAATAGCACCCACAGCCGGAAC
CFTR-C031  CTCTGGCTGCTGGGGAACACCCCCCTCCAGGATAAGGGGAATAGCACCCACAGCCGGAAC
CFTR-C018  CTGTGGCTCCTCGGGAACACACCGCTGCAAGACAAGGGCAACAGCACCCATAGCCGAAAC
CFTR-C043  CTGTGGCTCCTCGGGAACACACCGCTGCAAGACAAGGGCAACAGCACCCATAGCCGAAAC
CFTR-C003  CTGTGGCTGCTGGGCAACACCCCTCTGCAGGACAAAGGCAACTCCACCCACAGCAGGAAC
CFTR-C028  CTGTGGCTGCTGGGCAACACCCCTCTGCAGGACAAAGGCAACTCCACCCACAGCAGGAAC
CFTR-C016  CTTTGGCTGCTGGGGAACACCCCGCTGCAGGACAAAGGTAACTCTACACACTCGCGGAAC
CFTR-C041  CTTTGGCTGCTGGGGAACACCCCGCTGCAGGACAAAGGTAACTCTACACACTCGCGGAAC
CFTR-C010  CTGTGGCTGCTGGGCAACACCCCCCTGCAGGACAAGGGAAACAGCACCCATTCCCGGAAC
CFTR-C035  CTGTGGCTGCTGGGCAACACCCCCCTGCAGGACAAGGGAAACAGCACCCATTCCCGGAAC
CFTR-C012  CTGTGGCTCCTGGGCAATACCCCCCTGCAGGACAAAGGCAACAGCACTCATAGCAGGAAT
CFTR-C037  CTGTGGCTCCTGGGCAATACCCCCCTGCAGGACAAAGGCAACAGCACTCATAGCAGGAAT
CFTR-C009  CTGTGGCTCCTGGGCAACACCCCCCTGCAGGACAAAGGCAACAGCACGCACAGCCGGAAC
CFTR-C034  CTGTGGCTCCTGGGCAACACCCCCCTGCAGGACAAAGGCAACAGCACGCACAGCCGGAAC
CFTR-C015  CTGTGGCTGCTGGGAAACACCCCCCTGCAAGACAAGGGCAATTCCACCCACAGCAGGAAC
CFTR-C040  CTGTGGCTGCTGGGAAACACCCCCCTGCAAGACAAGGGCAATTCCACCCACAGCAGGAAC
CFTR-C019  CTGTGGCTGCTCGGCAACACCCCCCTGCAGGACAAGGGCAACTCCACCCACAGCAGGAAC
CFTR-C044  CTGTGGCTGCTCGGCAACACCCCCCTGCAGGACAAGGGCAACTCCACCCACAGCAGGAAC
CFTR-C007  CTCTGGCTGCTGGGCAATACGCCCCTGCAGGACAAGGGCAACAGCACCCATTCCAGGAAT
CFTR-C032  CTCTGGCTGCTGGGCAATACGCCCCTGCAGGACAAGGGCAACAGCACCCATTCCAGGAAT
CFTR-C014  CTGTGGCTGCTCGGCAACACACCACTGCAGGACAAGGGCAACAGCACCCACTCCCGTAAT
CFTR-C039  CTGTGGCTGCTCGGCAACACACCACTGCAGGACAAGGGCAACAGCACCCACTCCCGTAAT
CFTR-C025  CTGTGGCTGCTGGGCAACACCCCCCTGCAGGACAAGGGCAACAGCACCCATAGCCGAAAT
CFTR-C050  CTGTGGCTGCTGGGCAACACCCCCCTGCAGGACAAGGGCAACAGCACCCATAGCCGAAAT
CFTR-C023  CTGTGGCTGCTCGGCAACACGCCCCTGCAGGACAAGGGCAACAGCACCCATTCCAGGAAC
CFTR-C048  CTGTGGCTGCTCGGCAACACGCCCCTGCAGGACAAGGGCAACAGCACCCATTCCAGGAAC
CFTR-C024  CTCTGGCTGCTGGGGAATACCCCCCTGCAAGACAAGGGAAACTCTACCCATAGCCGCAAC
CFTR-C049  CTCTGGCTGCTGGGGAATACCCCCCTGCAAGACAAGGGAAACTCTACCCATAGCCGCAAC
           **  *****  *  **  ** **  ** **  **,**,**,**  **,   ,** **,    * **,
```

FIG. 10 (cont)

```
CFTR-WT    AACAGCTATGCAGTGATTATCACCAGCACCAGTTCGTATTATGTGTTTTACATTTACGTG
CFTR-C001  AATAGCTACGCGGTAATCATCACCAGCACATCCAGCTACTACGTCTTCTACATCTACGTG
CFTR-C026  AATAGCTACGCGGTAATCATCACCAGCACATCCAGCTACTACGTCTTCTACATCTACGTG
CFTR-C004  AACAGCTACGCCGTGATCATCACCTCCACCTCGAGCTACTACGTGTTCTATATCTACGTG
CFTR-C029  AACAGCTACGCCGTGATCATCACCTCCACCTCGAGCTACTACGTGTTCTATATCTACGTG
CFTR-C021  AACAGCTACGCGGTGATCATCACAAGCACGAGCAGCTACTACGTCTTTTACATCTACGTC
CFTR-C046  AACAGCTACGCGGTGATCATCACAAGCACGAGCAGCTACTACGTCTTTTACATCTACGTC
CFTR-C008  AACAGCTACGCCGTGATCATCACCTCCACCAGCTCTTACTATGTGTTCTACATCTACGTG
CFTR-C033  AACAGCTACGCCGTGATCATCACCTCCACCAGCTCTTACTATGTGTTCTACATCTACGTG
CFTR-C022  AACAGCTACGCCGTGATCATCACCAGCACCTCCAGCTACTACGTCTTCTATATCTACGTG
CFTR-C047  AACAGCTACGCCGTGATCATCACCAGCACCTCCAGCTACTACGTCTTCTATATCTACGTG
CFTR-C017  AATAGCTACGCCGTTATAATCACCAGCACCTCCTCCTATTATGTGTTCTACATCTATGTG
CFTR-C042  AATAGCTACGCCGTTATAATCACCAGCACCTCCTCCTATTATGTGTTCTACATCTATGTG
CFTR-C020  AATAGCTACGCCGTGATCATCACCAGCACCAGCAGCTACTATGTGTTCTACATCTACGTG
CFTR-C045  AATAGCTACGCCGTGATCATCACCAGCACCAGCAGCTACTATGTGTTCTACATCTACGTG
CFTR-C013  AATAGCTACGCCGTGATCATCACGTCGACCAGCTCGTACTACGTGTTCTACATCTACGTG
CFTR-C038  AATAGCTACGCCGTGATCATCACGTCGACCAGCTCGTACTACGTGTTCTACATCTACGTG
CFTR-C002  AACAGCTACGCCGTGATCATCACCTCCACCAGCAGCTACTATGTGTTCTACATCTACGTC
CFTR-C027  AACAGCTACGCCGTGATCATCACCTCCACCAGCAGCTACTATGTGTTCTACATCTACGTC
CFTR-C011  AACAGCTACGCCGTGATCATCACCAGCACCAGCAGTTACTATGTGTTCTACATCTACGTC
CFTR-C036  AACAGCTACGCCGTGATCATCACCAGCACCAGCAGTTACTATGTGTTCTACATCTACGTC
CFTR-C005  AACTCCTATGCCGTCATAATCACCTCCACCAGCAGCTACTACGTCTTCTACATTTACGTG
CFTR-C030  AACTCCTATGCCGTCATAATCACCTCCACCAGCAGCTACTACGTCTTCTACATTTACGTG
CFTR-C006  AACTCCTACGCCGTGATCATCACATCCACCTCCTCCTATTATGTCTTTTACATCTACGTC
CFTR-C031  AACTCCTACGCCGTGATCATCACATCCACCTCCTCCTATTATGTCTTTTACATCTACGTC
CFTR-C018  AACTCCTACGCCGTGATTATAACCAGCACCAGCTCTTATTACGTCTTCTACATCTATGTG
CFTR-C043  AACTCCTACGCCGTGATTATAACCAGCACCAGCTCTTATTACGTCTTCTACATCTATGTG
CFTR-C003  AATAGCTACGCGGTGATCATCACCAGCACCAGCTCCTACTACGTGTTCTACATCTACGTC
CFTR-C028  AATAGCTACGCGGTGATCATCACCAGCACCAGCTCCTACTACGTGTTCTACATCTACGTC
CFTR-C016  AACTCCTATGCGGTCATCATTACGAGCACCTCCTCCTACTATGTGTTCTACATCTACGTG
CFTR-C041  AACTCCTATGCGGTCATCATTACGAGCACCTCCTCCTACTATGTGTTCTACATCTACGTG
CFTR-C010  AATAGCTACGCCGTCATCATCACCAGCACCTCCAGCTATTACGTGTTCTATATCTACGTC
CFTR-C035  AATAGCTACGCCGTCATCATCACCAGCACCTCCAGCTATTACGTGTTCTATATCTACGTC
CFTR-C012  AACTCCTACGCCGTGATAATCACAAGCACCAGCAGCTACTACGTGTTCTACATATATGTG
CFTR-C037  AACTCCTACGCCGTGATAATCACAAGCACCAGCAGCTACTACGTGTTCTACATATATGTG
CFTR-C009  AACTCCTACGCCGTGATCATCACCTCCACCAGCTCCTACTACGTCTTCTACATCTACGTG
CFTR-C034  AACTCCTACGCCGTGATCATCACCTCCACCAGCTCCTACTACGTCTTCTACATCTACGTG
CFTR-C015  AACTCCTATGCCGTCATCATCACCAGCACGAGCAGCTACTACGTGTTCTACATCTATGTG
CFTR-C040  AACTCCTATGCCGTCATCATCACCAGCACGAGCAGCTACTACGTGTTCTACATCTATGTG
CFTR-C019  AACAGCTACGCCGTGATCATCACCAGCACGTCCAGCTACTACGTCTTCTACATCTATGTG
CFTR-C044  AACAGCTACGCCGTGATCATCACCAGCACGTCCAGCTACTACGTCTTCTACATCTATGTG
CFTR-C007  AACTCGTACGCCGTGATCATCACCAGCACTTCCAGCTACTACGTGTTCTATATATACGTG
CFTR-C032  AACTCGTACGCCGTGATCATCACCAGCACTTCCAGCTACTACGTGTTCTATATATACGTG
CFTR-C014  AACTCCTACGCCGTGATAATAACCAGCACCAGCAGCTACTACGTTTTTACATCTACGTC
CFTR-C039  AACTCCTACGCCGTGATAATAACCAGCACCAGCAGCTACTACGTTTTTACATCTACGTC
CFTR-C025  AACTCTTATGCCGTGATCATCACCAGCACCTCGAGCTATTACGTCTTCTACATCTATGTG
CFTR-C050  AACTCTTATGCCGTGATCATCACCAGCACCTCGAGCTATTACGTCTTCTACATCTATGTG
CFTR-C023  AATTCGTATGCCGTGATCATCACCTCCACCAGCAGCTATTACGTGTTCTACATTTACGTG
CFTR-C048  AATTCGTATGCCGTGATCATCACCTCCACCAGCAGCTATTACGTGTTCTACATTTACGTG
CFTR-C024  AATAGCTACGCGGTCATAATAACCTCCACCAGCAGCTACTACGTGTTTATATCTATGTG
CFTR-C049  AATAGCTACGCGGTCATAATAACCTCCACCAGCAGCTACTACGTGTTTTATATCTATGTG
           **. **.**.** ** ** **      **         **.**.** **.**.** **.**
```

FIG. 10 (cont)

```
CFTR-WT    GGAGTAGCCGACACTTTGCTTGCTATGGGATTCTTCAGAGGTCTACCACTGGTGCATACT
CFTR-CO01  GGCGTAGCCGACACCCTCCTGGCCATGGGGTTCTTCCGCGGGCTGCCCCTGGTGCACACC
CFTR-CO26  GGCGTAGCCGACACCCTCCTGGCCATGGGGTTCTTCCGCGGGCTGCCCCTGGTGCACACC
CFTR-CO04  GGCGTGGCCGACACCCTGCTGGCCATGGGTTTCTTCAGGGGCCTGCCCCTCGTGCACACC
CFTR-CO29  GGCGTGGCCGACACCCTGCTGGCCATGGGTTTCTTCAGGGGCCTGCCCCTCGTGCACACC
CFTR-CO21  GGGGTCGCCGACACCCTCCTGGCCATGGGCTTCTTTCGCGGGCTGCCCCTGGTGCACACC
CFTR-CO46  GGGGTCGCCGACACCCTCCTGGCCATGGGCTTCTTTCGCGGGCTGCCCCTGGTGCACACC
CFTR-CO08  GGAGTTGCCGACACCCTGCTGGCCATGGGCTTCTTCCGCGGCCTGCCCCTGGTGCACACC
CFTR-CO33  GGAGTTGCCGACACCCTGCTGGCCATGGGCTTCTTCCGCGGCCTGCCCCTGGTGCACACC
CFTR-CO22  GGCGTGGCGGACACCCTGCTGGCTATGGGGTTCTTTCGGGGCCTGCCACTGGTGCACACC
CFTR-CO47  GGCGTGGCGGACACCCTGCTGGCTATGGGGTTCTTTCGGGGCCTGCCACTGGTGCACACC
CFTR-CO17  GGTGTGGCCGATACCCTGTTAGCCATGGGCTTTTTCCGGGGCCTGCCCCTGGTGCACACC
CFTR-CO42  GGTGTGGCCGATACCCTGTTAGCCATGGGCTTTTTCCGGGGCCTGCCCCTGGTGCACACC
CFTR-CO20  GGTGTGGCCGACACCCTGCTGGCCATGGGCTTCTTCAGAGGCCTACCCCTAGTGCACACC
CFTR-CO45  GGTGTGGCCGACACCCTGCTGGCCATGGGCTTCTTCAGAGGCCTACCCCTAGTGCACACC
CFTR-CO13  GGCGTGGCGGACACGCTGCTGGCCATGGGCTTCTTTCGCGGGCTGCCCCTGGTGCACACC
CFTR-CO38  GGCGTGGCGGACACGCTGCTGGCCATGGGCTTCTTTCGCGGGCTGCCCCTGGTGCACACC
CFTR-CO02  GGCGTGGCCGACACCCTGCTGGCCATGGGCTTCTTTCGCGGGCTGCCGCTTGTGCACACC
CFTR-CO27  GGCGTGGCCGACACCCTGCTGGCCATGGGCTTCTTTCGCGGGCTGCCGCTTGTGCACACC
CFTR-CO11  GGGGTGGCGGACACACTGCTCGCAATGGGATTCTTCCGCGGGCTGCCGCTGGTGCACACC
CFTR-CO36  GGGGTGGCGGACACACTGCTCGCAATGGGATTCTTCCGCGGGCTGCCGCTGGTGCACACC
CFTR-CO05  GGGGTGGCCGACACCCTGCTGGCCATGGGGTTCTTCCGGGGCCTGCCGCTGGTGCACACC
CFTR-CO30  GGGGTGGCCGACACCCTGCTGGCCATGGGGTTCTTCCGGGGCCTGCCGCTGGTGCACACC
CFTR-CO06  GGGGTGGCGGACACGCTGCTGGCAATGGGCTTCTTCCGGGGTCTGCCCCTGGTGCATACC
CFTR-CO31  GGGGTGGCGGACACGCTGCTGGCAATGGGCTTCTTCCGGGGTCTGCCCCTGGTGCATACC
CFTR-CO18  GGGGTCGCCGATACCCTCCTGGCCATGGGCTTCTTCAGGGGCCTGCCCCTGGTCCATACC
CFTR-CO43  GGGGTCGCCGATACCCTCCTGGCCATGGGCTTCTTCAGGGGCCTGCCCCTGGTCCATACC
CFTR-CO03  GGCGTGGCCGACACCCTGCTGGCGATGGGCTTCTTCAGGGGCTGCCGCTGGTGCACACC
CFTR-CO28  GGCGTGGCCGACACCCTGCTGGCGATGGGCTTCTTCAGGGGCTGCCGCTGGTGCACACC
CFTR-CO16  GGCGTGGCCGACACCCTGCTGGCCATGGGCTTCTTCCGTGGTCTGCCGCTGGTGCACACA
CFTR-CO41  GGCGTGGCCGACACCCTGCTGGCCATGGGCTTCTTCCGTGGTCTGCCGCTGGTGCACACA
CFTR-CO10  GGGGTGGCGGACACCCTCCTGGCGATGGGCTTCTTCAGGGGCCTGCCCCTGGTGCACACC
CFTR-CO35  GGGGTGGCGGACACCCTCCTGGCGATGGGCTTCTTCAGGGGCCTGCCCCTGGTGCACACC
CFTR-CO12  GGCGTGGCCGATACCCTGCTGGCCATGGGCTTCTTCAGGGGCTGCCCCTGGTGCACACC
CFTR-CO37  GGCGTGGCCGATACCCTGCTGGCCATGGGCTTCTTCAGGGGCTGCCCCTGGTGCACACC
CFTR-CO09  GGGGTCGCCGACACCCTGCTGGCCATGGGCTTTTTCAGGGGCCTGCCACTGGTCCACACC
CFTR-CO34  GGGGTCGCCGACACCCTGCTGGCCATGGGCTTTTTCAGGGGCCTGCCACTGGTCCACACC
CFTR-CO15  GGAGTCGCCGACACACTGCTGGCCATGGGCTTCTTCAGGGGCTGCCCCTGGTCCACACG
CFTR-CO40  GGAGTCGCCGACACACTGCTGGCCATGGGCTTCTTCAGGGGCTGCCCCTGGTCCACACG
CFTR-CO19  GGCGTGGCTGACACCCTTCTGGCCATGGGCTTCTTTCGCGGGCTGCCCCTGGTCCACACC
CFTR-CO44  GGCGTGGCTGACACCCTTCTGGCCATGGGCTTCTTTCGCGGGCTGCCCCTGGTCCACACC
CFTR-CO07  GGGGTGGCGGACACCCTGCTGGCCATGGGCTTCTTTCGCGGTCTGCCCCTCGTGCACACC
CFTR-CO32  GGGGTGGCGGACACCCTGCTGGCCATGGGCTTCTTTCGCGGTCTGCCCCTCGTGCACACC
CFTR-CO14  GGGGTGGCCGATACCCTGCTGGCCATGGGTTTCTTCAGGGGCCTGCCCCTGGTGCATACG
CFTR-CO39  GGGGTGGCCGATACCCTGCTGGCCATGGGTTTCTTCAGGGGCCTGCCCCTGGTGCATACG
CFTR-CO25  GGGGTGGCCGACACGCTTCTGGCAATGGGCTTCTTCAGAGGACTGCCCCTAGTGCACACG
CFTR-CO50  GGGGTGGCCGACACGCTTCTGGCAATGGGCTTCTTCAGAGGACTGCCCCTAGTGCACACG
CFTR-CO23  GGGGTGGCCGACACCCTGCTGGCCATGGGGTTCTTCAGAGGGCTGCCACTGGTCCACACC
CFTR-CO48  GGGGTGGCCGACACCCTGCTGGCCATGGGGTTCTTCAGAGGGCTGCCACTGGTCCACACC
CFTR-CO24  GGAGTGGCCGACACCCTGCTGGCAATGGGCTTCTTCAGGGGCCTGCCCCTGGTGCACACC
CFTR-CO49  GGAGTGGCCGACACCCTGCTGGCAATGGGCTTCTTCAGGGGCCTGCCCCTGGTGCACACC
           ** ** ** **,**  ,*  ,* ** ***** **,**, * ** **,** ** ** **,**
```

FIG. 10 (cont)

```
CFTR-WT   CTAATCACAGTGTCGAAAATTTTACACCACAAAATGTTACATTCTGTTCTTCAAGCACCT
CFTR-C001 CTCATCACCGTGAGCAAAATCCTGCACCATAAGATGCTGCATTCCGTGCTCCAGGCCCCC
CFTR-C026 CTCATCACCGTGAGCAAAATCCTGCACCATAAGATGCTGCATTCCGTGCTCCAGGCCCCC
CFTR-C004 CTCATAACTGTCAGCAAGATCCTGCACCACAAGATGCTCCACAGCGTTCTGCAGGCCCCC
CFTR-C029 CTCATAACTGTCAGCAAGATCCTGCACCACAAGATGCTCCACAGCGTTCTGCAGGCCCCC
CFTR-C021 CTGATCACCGTGAGCAAGATTCTCCACCACAAGATGCTGCACTCCGTGCTGCAGGCCCCC
CFTR-C046 CTGATCACCGTGAGCAAGATTCTCCACCACAAGATGCTGCACTCCGTGCTGCAGGCCCCC
CFTR-C008 CTGATCACCGTGAGCAAGATCCTCCACCACAAGATGCTGCACAGCGTGCTGCAGGCCCCA
CFTR-C033 CTGATCACCGTGAGCAAGATCCTCCACCACAAGATGCTGCACAGCGTGCTGCAGGCCCCA
CFTR-C022 CTGATAACCGTCAGCAAGATCCTGCATCACAAGATGCTGCACAGCGTCCTGCAAGCTCCC
CFTR-C047 CTGATAACCGTCAGCAAGATCCTGCATCACAAGATGCTGCACAGCGTCCTGCAAGCTCCC
CFTR-C017 CTAATCACCGTGAGCAAAATCCTCCACCACAAGATGCTGCATTCCGTGCTGCAGGCCCCC
CFTR-C042 CTAATCACCGTGAGCAAAATCCTCCACCACAAGATGCTGCATTCCGTGCTGCAGGCCCCC
CFTR-C020 CTGATCACCGTCTCGAAGATCCTCCACCACAAGATGCTGCACAGCGTGCTGCAAGCCCCC
CFTR-C045 CTGATCACCGTCTCGAAGATCCTCCACCACAAGATGCTGCACAGCGTGCTGCAAGCCCCC
CFTR-C013 CTGATAACCGTGAGCAAGATCCTGCACCATAAGATGCTCCACAGCGTCCTCCAGGCCCCC
CFTR-C038 CTGATAACCGTGAGCAAGATCCTGCACCATAAGATGCTCCACAGCGTCCTCCAGGCCCCC
CFTR-C002 CTGATCACCGTGAGCAAGATCCTGCACCACAAGATGCTGCACTCCGTGCTACAGGCGCCC
CFTR-C027 CTGATCACCGTGAGCAAGATCCTGCACCACAAGATGCTGCACTCCGTGCTACAGGCGCCC
CFTR-C011 CTGATCACCGTCAGCAAGATCCTGCATCACAAGATGCTGCACAGCGTCCTGCAGGCCCCC
CFTR-C036 CTGATCACCGTCAGCAAGATCCTGCATCACAAGATGCTGCACAGCGTCCTGCAGGCCCCC
CFTR-C005 CTCATTACCGTGTCGAAGATCCTGCACCACAAGATGCTGCACAGCGTGCTGCAGGCCCCC
CFTR-C030 CTCATTACCGTGTCGAAGATCCTGCACCACAAGATGCTGCACAGCGTGCTGCAGGCCCCC
CFTR-C006 CTGATCACCGTGTCCAAGATTCTGCACCACAAAATGCTGCACAGCGTGCTTCAGGCCCCG
CFTR-C031 CTGATCACCGTGTCCAAGATTCTGCACCACAAAATGCTGCACAGCGTGCTTCAGGCCCCG
CFTR-C018 CTGATCACCGTCAGCAAGATACTCCACCACAAGATGCTGCATAGCGTGCTCCAAGCCCCG
CFTR-C043 CTGATCACCGTCAGCAAGATACTCCACCACAAGATGCTGCATAGCGTGCTCCAAGCCCCG
CFTR-C003 CTGATCACCGTGTCCAAAATCCTGCACCACAAGATGCTCCACTCTGTGCTGCAGGCCCCC
CFTR-C028 CTGATCACCGTGTCCAAAATCCTGCACCACAAGATGCTCCACTCTGTGCTGCAGGCCCCC
CFTR-C016 CTCATCACCGTGAGCAAAATCCTGCACCACAAGATGCTGCACTCCGTGCTGCAGGCCCCG
CFTR-C041 CTCATCACCGTGAGCAAAATCCTGCACCACAAGATGCTGCACTCCGTGCTGCAGGCCCCG
CFTR-C010 CTGATCACCGTGAGCAAGATCCTGCACCACAAGATGCTGCACTCCGTGCTGCAGGCCCCC
CFTR-C035 CTGATCACCGTGAGCAAGATCCTGCACCACAAGATGCTGCACTCCGTGCTGCAGGCCCCC
CFTR-C012 CTGATCACGGTGAGCAAGATCCTGCACCACAAGATGCTCCACAGCGTACTGCAGGCCCCC
CFTR-C037 CTGATCACGGTGAGCAAGATCCTGCACCACAAGATGCTCCACAGCGTACTGCAGGCCCCC
CFTR-C009 CTGATCACCGTGAGCAAAATCCTGCATCACAAGATGCTCCACTCCGTGCTGCAGGCCCCC
CFTR-C034 CTGATCACCGTGAGCAAAATCCTGCATCACAAGATGCTCCACTCCGTGCTGCAGGCCCCC
CFTR-C015 CTGATCACCGTCAGCAAGATCCTGCACCATAAGATGCTCCACAGCGTCCTGCAGGCGCCC
CFTR-C040 CTGATCACCGTCAGCAAGATCCTGCACCATAAGATGCTCCACAGCGTCCTGCAGGCGCCC
CFTR-C019 CTCATAACGGTGTCCAAGATCCTGCACCACAAAATGCTGCACAGCGTGCTGCAGGCCCCC
CFTR-C044 CTCATAACGGTGTCCAAGATCCTGCACCACAAAATGCTGCACAGCGTGCTGCAGGCCCCC
CFTR-C007 CTCATCACCGTGTCCAAAATCCTGCATCACAAGATGCTGCACAGCGTGCTGCAGGCCCCC
CFTR-C032 CTCATCACCGTGTCCAAAATCCTGCATCACAAGATGCTGCACAGCGTGCTGCAGGCCCCC
CFTR-C014 CTGATCACCGTGAGCAAGATCCTGCACCATAAGATGCTGCACTCCGTGCTGCAGGCCCCC
CFTR-C039 CTGATCACCGTGAGCAAGATCCTGCACCATAAGATGCTGCACTCCGTGCTGCAGGCCCCC
CFTR-C025 CTGATAACCGTGAGCAAGATCCTGCACCATAAGATGCTGCACTCCGTGCTCCAGGCCCCC
CFTR-C050 CTGATAACCGTGAGCAAGATCCTGCACCATAAGATGCTGCACTCCGTGCTCCAGGCCCCC
CFTR-C023 CTGATAACCGTGTCCAAGATCCTGCACCACAAGATGCTGCACAGCGTGCTGCAGGCCCCC
CFTR-C048 CTGATAACCGTGTCCAAGATCCTGCACCACAAGATGCTGCACAGCGTGCTGCAGGCCCCC
CFTR-C024 CTGATCACCGTGTCCAAGATCCTCCATCACAAAATGCTCCACTCGGTCCTGCAGGCGCCC
CFTR-C049 CTGATCACCGTGTCCAAGATCCTCCATCACAAAATGCTCCACTCGGTCCTGCAGGCGCCC
          ** ** ** **     **,** ,* **,**,**,*** ,* **,   ** ** **,** **
```

FIG. 10 (cont)

| | |
|---|---|
| CFTR-WT | ATGTCAACCCTCAACACGTTGAAAGCAGGTGGGATTCTTAATAGATTCTCCAAAGATATA |
| CFTR-C001 | ATGAGCACCCTGAACACCCTGAAGGCGGGCGGAATCCTCAACCGGTTCAGCAAGGACATC |
| CFTR-C026 | ATGAGCACCCTGAACACCCTGAAGGCGGGCGGAATCCTCAACCGGTTCAGCAAGGACATC |
| CFTR-C004 | ATGAGCACCCTGAACACCCTGAAGGCCGGCGGCATCCTGAACCGGTTTAGCAAGGACATA |
| CFTR-C029 | ATGAGCACCCTGAACACCCTGAAGGCCGGCGGCATCCTGAACCGGTTTAGCAAGGACATA |
| CFTR-C021 | ATGAGCACCCTGAACACCCTGAAGGCCGGTGGCATCCTGAATCGGTTCAGCAAGGATATC |
| CFTR-C046 | ATGAGCACCCTGAACACCCTGAAGGCCGGTGGCATCCTGAATCGGTTCAGCAAGGATATC |
| CFTR-C008 | ATGAGCACCCTGAACACCCTGAAGGCCGGGGGCATCCTCAACAGGTTTAGCAAAGACATC |
| CFTR-C033 | ATGAGCACCCTGAACACCCTGAAGGCCGGGGGCATCCTCAACAGGTTTAGCAAAGACATC |
| CFTR-C022 | ATGAGCACCCTGAACACCCTCAAAGCCGGCGGAATCCTGAACCGCTTCAGCAAGGACATC |
| CFTR-C047 | ATGAGCACCCTGAACACCCTCAAAGCCGGCGGAATCCTGAACCGCTTCAGCAAGGACATC |
| CFTR-C017 | ATGAGCACCCTGAACACCCTGAAGGCGGGAGGCATCCTCAACAGGTTCTCCAAGGACATT |
| CFTR-C042 | ATGAGCACCCTGAACACCCTGAAGGCGGGAGGCATCCTCAACAGGTTCTCCAAGGACATT |
| CFTR-C020 | ATGTCCACCCTCAATACCCTGAAAGCCGGCGGAATCCTCAACCGATTTCCAAGGACATC |
| CFTR-C045 | ATGTCCACCCTCAATACCCTGAAAGCCGGCGGAATCCTCAACCGATTTCCAAGGACATC |
| CFTR-C013 | ATGAGCACCCTGAACACGCTGAAGGCCGGCGGGATCCTGAACAGGTTCTCTAAGGACATC |
| CFTR-C038 | ATGAGCACCCTGAACACGCTGAAGGCCGGCGGGATCCTGAACAGGTTCTCTAAGGACATC |
| CFTR-C002 | ATGAGCACCCTGAACACGCTGAAAGCCGGAGGCATCCTGAATAGGTTCTCAAAGGATATC |
| CFTR-C027 | ATGAGCACCCTGAACACGCTGAAAGCCGGAGGCATCCTGAATAGGTTCTCAAAGGATATC |
| CFTR-C011 | ATGTCCACCCTCAACACCCTGAAGGCCGGGGGGATCCTGAACCGGTTCTCCAAGGACATC |
| CFTR-C036 | ATGTCCACCCTCAACACCCTGAAGGCCGGGGGGATCCTGAACCGGTTCTCCAAGGACATC |
| CFTR-C005 | ATGTCCACCCTGAACACCCTGAAGGCCGGCGGGATCCTCAACCGCTTTAGCAAGGACATC |
| CFTR-C030 | ATGTCCACCCTGAACACCCTGAAGGCCGGCGGGATCCTCAACCGCTTTAGCAAGGACATC |
| CFTR-C006 | ATGTCCACACTCAACACCCTCAAGGCCGGGGGCATCCTGAACCGGTTTTCCAAGGACATC |
| CFTR-C031 | ATGTCCACACTCAACACCCTCAAGGCCGGGGGCATCCTGAACCGGTTTTCCAAGGACATC |
| CFTR-C018 | ATGAGCACCCTGAATACTCTGAAGGCAGGCGGCATTCTCAACAGGTTCTCGAAGGACATC |
| CFTR-C043 | ATGAGCACCCTGAATACTCTGAAGGCAGGCGGCATTCTCAACAGGTTCTCGAAGGACATC |
| CFTR-C003 | ATGAGCACCCTGAACACCCTGAAGGCCGGCGGCATCCTGAACCGGTTTAGCAAAGACATC |
| CFTR-C028 | ATGAGCACCCTGAACACCCTGAAGGCCGGCGGCATCCTGAACCGGTTTAGCAAAGACATC |
| CFTR-C016 | ATGTCCACCCTGAACACCCTAAAGGCTGGCGGCATCCTGAACAGGTTCAGCAAGGACATC |
| CFTR-C041 | ATGTCCACCCTGAACACCCTAAAGGCTGGCGGCATCCTGAACAGGTTCAGCAAGGACATC |
| CFTR-C010 | ATGAGCACCCTCAATACGTTGAAAGCGGGCGGAATCCTGAACAGGTTCTCCAAAGACATC |
| CFTR-C035 | ATGAGCACCCTCAATACGTTGAAAGCGGGCGGAATCCTGAACAGGTTCTCCAAAGACATC |
| CFTR-C012 | ATGTCGACTCTGAACACCCTGAAGGCCGGCGGGATACTGAACAGGTTCAGCAAGGACATC |
| CFTR-C037 | ATGTCGACTCTGAACACCCTGAAGGCCGGCGGGATACTGAACAGGTTCAGCAAGGACATC |
| CFTR-C009 | ATGAGCACCCTGAATACCCTGAAGGCCGGCGGCATCCTGAACCGCTTTAGCAAGGACATC |
| CFTR-C034 | ATGAGCACCCTGAATACCCTGAAGGCCGGCGGCATCCTGAACCGCTTTAGCAAGGACATC |
| CFTR-C015 | ATGTCAACGCTGAACACCCTGAAGGCCGGTGGGATCCTGAACAGGTTCAGCAAGGACATC |
| CFTR-C040 | ATGTCAACGCTGAACACCCTGAAGGCCGGTGGGATCCTGAACAGGTTCAGCAAGGACATC |
| CFTR-C019 | ATGAGCACCCTGAACACCCTCAAGGCCGGCGGGATTCTGAACCGGTTCAGCAAGGATATC |
| CFTR-C044 | ATGAGCACCCTGAACACCCTCAAGGCCGGCGGGATTCTGAACCGGTTCAGCAAGGATATC |
| CFTR-C007 | ATGAGCACGCTCAACACCCTCAAGGCCGGCGGGATCCTGAATAGGTTCAGCAAGGACATC |
| CFTR-C032 | ATGAGCACGCTCAACACCCTCAAGGCCGGCGGGATCCTGAATAGGTTCAGCAAGGACATC |
| CFTR-C014 | ATGAGCACCCTGAATACCCTGAAGGCAGGCGGAATCCTTAACAGGTTTTCCAAGGACATC |
| CFTR-C039 | ATGAGCACCCTGAATACCCTGAAGGCAGGCGGAATCCTTAACAGGTTTTCCAAGGACATC |
| CFTR-C025 | ATGAGCACACTCAACACCCTCAAAGCAGGCGGCATCCTGAATCGGTTTAGCAAGGACATC |
| CFTR-C050 | ATGAGCACACTCAACACCCTCAAAGCAGGCGGCATCCTGAATCGGTTTAGCAAGGACATC |
| CFTR-C023 | ATGAGCACGCTGAACACGCTTAAGGCCGGCGGTATCCTGAACCGCTTCTCCAAGGACATC |
| CFTR-C048 | ATGAGCACGCTGAACACGCTTAAGGCCGGCGGTATCCTGAACCGCTTCTCCAAGGACATC |
| CFTR-C024 | ATGAGCACGCTGAACACCCTGAAGGCCGGCGGCATACTGAACCGCTTCAGCAAGGACATC |
| CFTR-C049 | ATGAGCACGCTGAACACCCTGAAGGCCGGCGGCATACTGAACCGCTTCAGCAAGGACATC |

FIG. 10 (cont)

| | |
|---|---|
| CFTR-WT | GCAATTTTGGATGACCTTCTGCCTCTTACCATATTTGACTTCATCCAGTTGTTATTAATT |
| CFTR-C001 | GCCATCCTGGACGACCTGCTGCCCCTCACCATCTTCGACTTTATCCAGCTGCTGCTGATC |
| CFTR-C026 | GCCATCCTGGACGACCTGCTGCCCCTCACCATCTTCGACTTTATCCAGCTGCTGCTGATC |
| CFTR-C004 | GCCATCCTCGATGACCTGCTGCCCCTGACCATCTTCGACTTCATCCAGCTCCTGCTGATC |
| CFTR-C029 | GCCATCCTCGATGACCTGCTGCCCCTGACCATCTTCGACTTCATCCAGCTCCTGCTGATC |
| CFTR-C021 | GCCATACTGGACGACCTGCTGCCCCTGACCATCTTCGACTTCATTCAGCTCCTACTGATC |
| CFTR-C046 | GCCATACTGGACGACCTGCTGCCCCTGACCATCTTCGACTTCATTCAGCTCCTACTGATC |
| CFTR-C008 | GCCATCCTGGACGACCTGCTGCCCCTGACCATCTTCGACTTCATCCAGCTCCTGCTGATC |
| CFTR-C033 | GCCATCCTGGACGACCTGCTGCCCCTGACCATCTTCGACTTCATCCAGCTCCTGCTGATC |
| CFTR-C022 | GCCATCCTGGACGATCTGCTGCCCCTCACCATCTTCGATTTTATCCAGCTCCTGCTGATC |
| CFTR-C047 | GCCATCCTGGACGATCTGCTGCCCCTCACCATCTTCGATTTTATCCAGCTCCTGCTGATC |
| CFTR-C017 | GCCATCCTCGATGATCTGCTGCCCCTGACCATCTTCGACTTCATACAGCTGCTGCTGATA |
| CFTR-C042 | GCCATCCTCGATGATCTGCTGCCCCTGACCATCTTCGACTTCATACAGCTGCTGCTGATA |
| CFTR-C020 | GCCATACTGGATGACTTACTGCCTTTGACCATCTTCGACTTCATCCAGCTGCTGCTGATC |
| CFTR-C045 | GCCATACTGGATGACTTACTGCCTTTGACCATCTTCGACTTCATCCAGCTGCTGCTGATC |
| CFTR-C013 | GCCATCCTCGACGACCTGCTGCCCCTGACTATCTTCGACTTCATCCAGCTGCTGCTCATC |
| CFTR-C038 | GCCATCCTCGACGACCTGCTGCCCCTGACTATCTTCGACTTCATCCAGCTGCTGCTCATC |
| CFTR-C002 | GCCATCCTGGACGACCTGCTCCCCCTGACCATCTTCGATTTCATTCAGCTACTGCTTATA |
| CFTR-C027 | GCCATCCTGGACGACCTGCTCCCCCTGACCATCTTCGATTTCATTCAGCTACTGCTTATA |
| CFTR-C011 | GCCATCCTGGACGACCTGCTGCCCCTGACCATCTTCGATTTCATCCAGCTGCTGCTGATC |
| CFTR-C036 | GCCATCCTGGACGACCTGCTGCCCCTGACCATCTTCGATTTCATCCAGCTGCTGCTGATC |
| CFTR-C005 | GCCATCCTGGACGACCTCCTGCCCCTGACCATCTTCGACTTCATCCAGCTGCTGCTGATC |
| CFTR-C030 | GCCATCCTGGACGACCTCCTGCCCCTGACCATCTTCGACTTCATCCAGCTGCTGCTGATC |
| CFTR-C006 | GCCATCTTGGACGACCTGCTGCCCCTGACGATTTTTGATTTCATCCAGCTGCTGCTGATC |
| CFTR-C031 | GCCATCTTGGACGACCTGCTGCCCCTGACGATTTTTGATTTCATCCAGCTGCTGCTGATC |
| CFTR-C018 | GCCATCCTGGACGACCTGCTCCCCCTGACCATCTTCGATTTCATCCAGCTGCTCCTGATA |
| CFTR-C043 | GCCATCCTGGACGACCTGCTCCCCCTGACCATCTTCGATTTCATCCAGCTGCTCCTGATA |
| CFTR-C003 | GCCATCCTGGACGACCTGCTGCCCCTCACCATCTTCGACTTCATTCAGCTGCTCCTGATC |
| CFTR-C028 | GCCATCCTGGACGACCTGCTGCCCCTCACCATCTTCGACTTCATTCAGCTGCTCCTGATC |
| CFTR-C016 | GCCATCCTGGACGACCTGCTGCCCCTGACCATCTTCGATTTCATTCAACTGCTGCTGATC |
| CFTR-C041 | GCCATCCTGGACGACCTGCTGCCCCTGACCATCTTCGATTTCATTCAACTGCTGCTGATC |
| CFTR-C010 | GCCATCCTGGACGACCTGCTGCCGCTGACCATCTTCGATTTCATCCAGCTGCTGCTGATC |
| CFTR-C035 | GCCATCCTGGACGACCTGCTGCCGCTGACCATCTTCGATTTCATCCAGCTGCTGCTGATC |
| CFTR-C012 | GCCATCCTGGACGACCTGCTGCCCCTCACGATCTTCGACTTCATCCAGCTGCTGCTGATC |
| CFTR-C037 | GCCATCCTGGACGACCTGCTGCCCCTCACGATCTTCGACTTCATCCAGCTGCTGCTGATC |
| CFTR-C009 | GCCATCCTGGACGACCTGCTGCCCCTGACCATTTTTGACTTTATCCAGCTGCTGCTGATC |
| CFTR-C034 | GCCATCCTGGACGACCTGCTGCCCCTGACCATTTTTGACTTTATCCAGCTGCTGCTGATC |
| CFTR-C015 | GCCATCCTGGACGACCTGCTCCCCCTGACCATCTTCGACTTTATCCAGCTGCTCCTGATC |
| CFTR-C040 | GCCATCCTGGACGACCTGCTCCCCCTGACCATCTTCGACTTTATCCAGCTGCTCCTGATC |
| CFTR-C019 | GCCATCCTGGACGACCTGCTGCCCCTGACCATCTTCGACTTCATCCAGCTGCTGCTTATC |
| CFTR-C044 | GCCATCCTGGACGACCTGCTGCCCCTGACCATCTTCGACTTCATCCAGCTGCTGCTTATC |
| CFTR-C007 | GCCATCCTCGACGACCTGCTGCCCCTCACCATCTTCGATTTCATCCAGCTCCTCCTGATC |
| CFTR-C032 | GCCATCCTCGACGACCTGCTGCCCCTCACCATCTTCGATTTCATCCAGCTCCTCCTGATC |
| CFTR-C014 | GCCATCCTGGACGACCTCCTGCCCCTGACCATCTTTGACTTCATCCAACTGCTGCTGATA |
| CFTR-C039 | GCCATCCTGGACGACCTCCTGCCCCTGACCATCTTTGACTTCATCCAACTGCTGCTGATA |
| CFTR-C025 | GCCATACTGGACGATCTGCTGCCCCTCACCATCTTCGACTTCATCCAGCTCCTGCTGATC |
| CFTR-C050 | GCCATACTGGACGATCTGCTGCCCCTCACCATCTTCGACTTCATCCAGCTCCTGCTGATC |
| CFTR-C023 | GCCATCCTCGACGACCTGCTCCCCCTGACCATCTTCGACTTCATCCAGCTGCTGCTCATC |
| CFTR-C048 | GCCATCCTCGACGACCTGCTCCCCCTGACCATCTTCGACTTCATCCAGCTGCTGCTCATC |
| CFTR-C024 | GCCATCCTGGATGACCTTCTCCCCCTCACCATCTTCGACTTCATCCAGCTCCTGCTGATC |
| CFTR-C049 | GCCATCCTGGATGACCTTCTCCCCCTCACCATCTTCGACTTCATCCAGCTCCTGCTGATC |
| |   .* .,.*    .*   .,  **,.* .* .* ** |

FIG. 10 (cont)

| | |
|---|---|
| CFTR-WT | GTGATTGGAGCTATAGCAGTTGTCGCAGTTTTACAACCCTACATCTTTGTTGCAACAGTG |
| CFTR-C001 | GTCATCGGGGCCATAGCCGTGGTGGCCGTTCTGCAGCCTTACATCTTCGTGGCCACCGTC |
| CFTR-C026 | GTCATCGGGGCCATAGCCGTGGTGGCCGTTCTGCAGCCTTACATCTTCGTGGCCACCGTC |
| CFTR-C004 | GTGATCGGCGCCATCGCCGTGGTGGCCGTGCTCCAGCCCTACATCTTCGTCGCCACGGTC |
| CFTR-C029 | GTGATCGGCGCCATCGCCGTGGTGGCCGTGCTCCAGCCCTACATCTTCGTCGCCACGGTC |
| CFTR-C021 | GTGATCGGCGCCATCGCCGTCGTGGCCGTCCTGCAGCCGTACATCTTCGTGGCAACGGTG |
| CFTR-C046 | GTGATCGGCGCCATCGCCGTCGTGGCCGTCCTGCAGCCGTACATCTTCGTGGCAACGGTG |
| CFTR-C008 | GTGATCGGGGCCATCGCCGTGGTGGCCGTGCTGCAACCCTACATCTTCGTGGCGACGGTG |
| CFTR-C033 | GTGATCGGGGCCATCGCCGTGGTGGCCGTGCTGCAACCCTACATCTTCGTGGCGACGGTG |
| CFTR-C022 | GTGATCGGCGCGATTGCAGTGGTGGCCGTGCTGCAGCCCTACATCTTCGTGGCCACCGTG |
| CFTR-C047 | GTGATCGGCGCGATTGCAGTGGTGGCCGTGCTGCAGCCCTACATCTTCGTGGCCACCGTG |
| CFTR-C017 | GTCATCGGCGCCATCGCCGTCGTGGCGGTGCTCCAGCCCTACATCTTTGTGGCCACGGTG |
| CFTR-C042 | GTCATCGGCGCCATCGCCGTCGTGGCGGTGCTCCAGCCCTACATCTTTGTGGCCACGGTG |
| CFTR-C020 | GTGATCGGGGCCATCGCCGTCGTGGCCGTCCTGCAGCCCTACATCTTCGTGGCAACGGTG |
| CFTR-C045 | GTGATCGGGGCCATCGCCGTCGTGGCCGTCCTGCAGCCCTACATCTTCGTGGCAACGGTG |
| CFTR-C013 | GTGATCGGCGCCATCGCCGTGGTGGCCGTGCTGCAGCCCTACATCTTCGTCGCAACCGTG |
| CFTR-C038 | GTGATCGGCGCCATCGCCGTGGTGGCCGTGCTGCAGCCCTACATCTTCGTCGCAACCGTG |
| CFTR-C002 | GTGATCGGGGCATCGCCGTGGTCGCCGTCCTCCAACCCTACATCTTCGTGGCGACCGTG |
| CFTR-C027 | GTGATCGGGGCCATCGCCGTGGTCGCCGTCCTCCAACCCTACATCTTCGTGGCGACCGTG |
| CFTR-C011 | GTGATCGGGGCCATCGCCGTGGTGGCGGTGCTGCAGCCCTACATCTTTGTTGCCACCGTG |
| CFTR-C036 | GTGATCGGGGCCATCGCCGTGGTGGCGGTGCTGCAGCCCTACATCTTTGTTGCCACCGTG |
| CFTR-C005 | GTGATCGGCGCCATCGCCGTAGTGGCGGTTCTCCAGCCCTACATCTTCGTGGCCACCGTG |
| CFTR-C030 | GTGATCGGCGCCATCGCCGTAGTGGCGGTTCTCCAGCCCTACATCTTCGTGGCCACCGTG |
| CFTR-C006 | GTCATTGGCGCGATCGCCGTGGTCGCCGTCCTGCAACCCTATATCTTCGTGGCCACCGTG |
| CFTR-C031 | GTCATTGGCGCGATCGCCGTGGTCGCCGTCCTGCAACCCTATATCTTCGTGGCCACCGTG |
| CFTR-C018 | GTGATCGGCGCCATCGCCGTGGTGGCGGTGCTCCAGCCCTACATCTTCGTCGCCACCGTC |
| CFTR-C043 | GTGATCGGCGCCATCGCCGTGGTGGCGGTGCTCCAGCCCTACATCTTCGTCGCCACCGTC |
| CFTR-C003 | GTGATCGGCGCCATCGCCGTCGTGGCCGTGCTCCAGCCCTACATCTTCGTCGCCACCGTG |
| CFTR-C028 | GTGATCGGCGCCATCGCCGTCGTGGCCGTGCTCCAGCCCTACATCTTCGTCGCCACCGTG |
| CFTR-C016 | GTGATAGGCGCGATCGCCGTCGTGGCCGTGCTGCAGCCCTACATCTTCGTGGCGACGGTC |
| CFTR-C041 | GTGATAGGCGCGATCGCCGTCGTGGCCGTGCTGCAGCCCTACATCTTCGTGGCGACGGTC |
| CFTR-C010 | GTGATAGGAGCCATCGCCGTCGTAGCCGTCCTGCAGCCCTACATCTTCGTGGCGACCGTC |
| CFTR-C035 | GTGATAGGAGCCATCGCCGTCGTAGCCGTCCTGCAGCCCTACATCTTCGTGGCGACCGTC |
| CFTR-C012 | GTGATCGGGGCCATCGCCGTGGTGGCCGTGCTGCAGCCCTACATCTTCGTCGCCACCGTG |
| CFTR-C037 | GTGATCGGGGCCATCGCCGTGGTGGCCGTGCTGCAGCCCTACATCTTCGTCGCCACCGTG |
| CFTR-C009 | GTGATAGGCGCCATCGCCGTGGTGGCCGTCCTGCAGCCCTATATCTTCGTGGCAACGGTC |
| CFTR-C034 | GTGATAGGCGCCATCGCCGTGGTGGCCGTCCTGCAGCCCTATATCTTCGTGGCAACGGTC |
| CFTR-C015 | GTGATCGGCGCCATCGCCGTGGTGGCCGTCCTCCAGCCCTACATTTTCGTGGCGACAGTC |
| CFTR-C040 | GTGATCGGCGCCATCGCCGTGGTGGCCGTCCTCCAGCCCTACATTTTCGTGGCGACAGTC |
| CFTR-C019 | GTGATCGGCGCTATCGCCGTGGTGGCCGTACTGCAGCCCTACATCTTCGTGGCGACGGTG |
| CFTR-C044 | GTGATCGGCGCTATCGCCGTGGTGGCCGTACTGCAGCCCTACATCTTCGTGGCGACGGTG |
| CFTR-C007 | GTGATCGGCGCCATCGCCGTGGTGGCCGTCCTCCAACCCTACATCTTTGTGGCCACCGTG |
| CFTR-C032 | GTGATCGGCGCCATCGCCGTGGTGGCCGTCCTCCAACCCTACATCTTTGTGGCCACCGTG |
| CFTR-C014 | GTCATCGGCGCAATCGCAGTGGTGGCAGTGCTGCAACCCTACATCTTCGTCGCCACCGTG |
| CFTR-C039 | GTCATCGGCGCAATCGCAGTGGTGGCAGTGCTGCAACCCTACATCTTCGTCGCCACCGTG |
| CFTR-C025 | GTGATCGGCGCCATCGCCGTGGTGGCCGTGTTACAGCCCTATATCTTCGTGGCGACCGTG |
| CFTR-C050 | GTGATCGGCGCCATCGCCGTGGTGGCCGTGTTACAGCCCTATATCTTCGTGGCGACCGTG |
| CFTR-C023 | GTGATAGGCGCAATCGCCGTGGTGGCCGTGCTTCAGCCGTACATCTTCGTGGCCACGGTG |
| CFTR-C048 | GTGATAGGCGCAATCGCCGTGGTGGCCGTGCTTCAGCCGTACATCTTCGTGGCCACGGTG |
| CFTR-C024 | GTGATCGGCGCCATCGCCGTGGTGGCCGTCCTGCAGCCCTATATCTTCGTGGCGACCGTG |
| CFTR-C049 | GTGATCGGCGCCATCGCCGTGGTGGCCGTCCTGCAGCCCTATATCTTCGTGGCGACCGTG |
| | ** ** ** ** ** ** ** ** ** ,* ** ** ** ,** ,** ,** ** ** ** |

FIG. 10 (cont)

| | |
|---|---|
| CFTR-WT   | CCAGTGATAGTGGCTTTTATTATGTTGAGAGCATATTTCCTCCAAACCTCACAGCAACTC |
| CFTR-C001 | CCCGTGATCGTGGCCTTCATCATGCTGCGGGCCTACTTCCTGCAAACCTCCCAGCAGCTG |
| CFTR-C026 | CCCGTGATCGTGGCCTTCATCATGCTGCGGGCCTACTTCCTGCAAACCTCCCAGCAGCTG |
| CFTR-C004 | CCCGTGATCGTGGCCTTCATCATGCTGCGCGCCTACTTCTCCAGACAAGCCAACAGCTG |
| CFTR-C029 | CCCGTGATCGTGGCCTTCATCATGCTGCGCGCCTACTTCTCCAGACAAGCCAACAGCTG |
| CFTR-C021 | CCCGTGATCGTGGCCTTTATCATGCTGCGGGCCTACTTCCTCCAGACCTCCCAGCAGCTC |
| CFTR-C046 | CCCGTGATCGTGGCCTTTATCATGCTGCGGGCCTACTTCCTCCAGACCTCCCAGCAGCTC |
| CFTR-C008 | CCCGTGATCGTGGCCTTCATCATGCTGCGCGCATACTTCCTCCAGACCAGCCAGCAGCTG |
| CFTR-C033 | CCCGTGATCGTGGCCTTCATCATGCTGCGCGCATACTTCCTCCAGACCAGCCAGCAGCTG |
| CFTR-C022 | CCGGTGATTGTGGCCTTCATCATGCTCCGGGCCTACTTCCTGCAGACCAGCCAGCAGCTG |
| CFTR-C047 | CCGGTGATTGTGGCCTTCATCATGCTCCGGGCCTACTTCCTGCAGACCAGCCAGCAGCTG |
| CFTR-C017 | CCCGTGATCGTGGCGTTTATCATGCTGCGGGCCTACTTCCTGCAGACCAGCCAGCAGCTG |
| CFTR-C042 | CCCGTGATCGTGGCGTTTATCATGCTGCGGGCCTACTTCCTGCAGACCAGCCAGCAGCTG |
| CFTR-C020 | CCCGTGATCGTAGCGTTTATTATGCTCCGGGCCTACTTCCTGCAGACGTCCCAGCAGCTC |
| CFTR-C045 | CCCGTGATCGTAGCGTTTATTATGCTCCGGGCCTACTTCCTGCAGACGTCCCAGCAGCTC |
| CFTR-C013 | CCAGTGATCGTGGCCTTCATCATGTTGAGGGCCTACTTCCTGCAGACCAGCCAGCAGCTG |
| CFTR-C038 | CCAGTGATCGTGGCCTTCATCATGTTGAGGGCCTACTTCCTGCAGACCAGCCAGCAGCTG |
| CFTR-C002 | CCCGTGATCGTCGCCTTCATCATGCTGAGGGCCTACTTCTACAGACCTCCCAACAGCTT |
| CFTR-C027 | CCCGTGATCGTCGCCTTCATCATGCTGAGGGCCTACTTCTACAGACCTCCCAACAGCTT |
| CFTR-C011 | CCGGTCATTGTGGCCTTTATCATGCTCCGGGCCTACTTCCTGCAAACCAGCCAGCAGCTG |
| CFTR-C036 | CCGGTCATTGTGGCCTTTATCATGCTCCGGGCCTACTTCCTGCAAACCAGCCAGCAGCTG |
| CFTR-C005 | CCGGTGATCGTGGCCTTTATCATGCTGAGGGCCTACTTCCTGCAGACCAGCCAGCAACTG |
| CFTR-C030 | CCGGTGATCGTGGCCTTTATCATGCTGAGGGCCTACTTCCTGCAGACCAGCCAGCAACTG |
| CFTR-C006 | CCGGTCATCGTGGCCTTTATCATGCTGCGAGCCTACTTCCTGCAGACGAGCCAGCAGCTG |
| CFTR-C031 | CCGGTCATCGTGGCCTTTATCATGCTGCGAGCCTACTTCCTGCAGACGAGCCAGCAGCTG |
| CFTR-C018 | CCCGTAATCGTGGCCTTCATCATGCTGCGCGCCTATTCCTGCAGACCAGCCAGCAGCTG |
| CFTR-C043 | CCCGTAATCGTGGCCTTCATCATGCTGCGCGCCTATTCCTGCAGACCAGCCAGCAGCTG |
| CFTR-C003 | CCGGTGATCGTGGCCTTCATCATGCTGAGGGCCTACTTCCTGCAGACGAGCCAGCAGCTG |
| CFTR-C028 | CCGGTGATCGTGGCCTTCATCATGCTGAGGGCCTACTTCCTGCAGACGAGCCAGCAGCTG |
| CFTR-C016 | CCCGTGATAGTGGCCTTCATAATGCTGAGGGCTTACTTCCTGCAAACCTCCCAACAGCTG |
| CFTR-C041 | CCCGTGATAGTGGCCTTCATAATGCTGAGGGCTTACTTCCTGCAAACCTCCCAACAGCTG |
| CFTR-C010 | CCGGTGATCGTGGCGTTCATCATGCTGCGGGCCTACTTCCTGCAGACCAGCCAGCAGCTG |
| CFTR-C035 | CCGGTGATCGTGGCGTTCATCATGCTGCGGGCCTACTTCCTGCAGACCAGCCAGCAGCTG |
| CFTR-C012 | CCCGTGATCGTGGCCTTCATCATGCTGAGGGCCTACTTCCTCCAGACCAGCCAGCAGCTG |
| CFTR-C037 | CCCGTGATCGTGGCCTTCATCATGCTGAGGGCCTACTTCCTCCAGACCAGCCAGCAGCTG |
| CFTR-C009 | CCGGTGATCGTCGCCTTCATCATGCTTAGAGCCTATTCCTGCAGACGTCCCAGCAACTG |
| CFTR-C034 | CCGGTGATCGTCGCCTTCATCATGCTTAGAGCCTATTCCTGCAGACGTCCCAGCAACTG |
| CFTR-C015 | CCGTCATCGTGGCCTTCATCATGCTGCGCGCCTACTTCCTGCAGACTAGCCAGCAGCTG |
| CFTR-C040 | CCCGTCATCGTGGCCTTCATCATGCTGCGCGCCTACTTCCTGCAGACTAGCCAGCAGCTG |
| CFTR-C019 | CCAGTGATCGTCGCCTTCATCATGCTGAGGGCCTACTTCCTTCAGACCAGCCAACAGCTG |
| CFTR-C044 | CCAGTGATCGTCGCCTTCATCATGCTGAGGGCCTACTTCCTTCAGACCAGCCAACAGCTG |
| CFTR-C007 | CCCGTGATAGTCGCCTTCATAATGCTGAGGGCCTATTTCTCCAGACCAGCCAACAACTG |
| CFTR-C032 | CCCGTGATAGTCGCCTTCATAATGCTGAGGGCCTATTTCTCCAGACCAGCCAACAACTG |
| CFTR-C014 | CCGGTGATCGTGGCCTTTATAATGCTGCGGGCCTACTTCTCCAGACCAGCCAACAGCTG |
| CFTR-C039 | CCGGTGATCGTGGCCTTTATAATGCTGCGGGCCTACTTCTCCAGACCAGCCAACAGCTG |
| CFTR-C025 | CCGGTGATCGTGGCCTTCATCATGCTCAGGGCCTACTTCTGCAGACGAGCCAGCAGCTG |
| CFTR-C050 | CCGGTGATCGTGGCCTTCATCATGCTCAGGGCCTACTTCTGCAGACGAGCCAGCAGCTG |
| CFTR-C023 | CCCGTGATCGTGGCCTTCATCATGCTGAGGGCCTACTTCCTCCAAACCAGCCAGCAGCTG |
| CFTR-C048 | CCCGTGATCGTGGCCTTCATCATGCTGAGGGCCTACTTCCTCCAAACCAGCCAGCAGCTG |
| CFTR-C024 | CCCGTCATCGTCGCCTTCATCATGCTGCGAGCCTACTTCCTGCAAACGAGCCAGCAGCTG |
| CFTR-C049 | CCCGTCATCGTCGCCTTCATCATGCTGCGAGCCTACTTCCTGCAAACGAGCCAGCAGCTG |
| |        * *  *   ,      ,, |

FIG. 10 (cont)

```
CFTR-WT   AAACAACTGGAATCTGAAGGCAGGAGTCCAATTTTCACTCATCTTGTTACAAGCTTAAAA
CFTR-C001 AAGCAGCTGGAAAGCGAGGGCCGGTCACCGATCTTCACCCATCTGGTCACCAGCCTGAAA
CFTR-C026 AAGCAGCTGGAAAGCGAGGGCCGGTCACCGATCTTCACCCATCTGGTCACCAGCCTGAAA
CFTR-C004 AAGCAGCTGGAGAGCGAGGGACGGAGCCCCATCTTCACCCACCTCGTGACCTCCCTGAAA
CFTR-C029 AAGCAGCTGGAGAGCGAGGGACGGAGCCCCATCTTCACCCACCTCGTGACCTCCCTGAAA
CFTR-C021 AAGCAGCTGGAGAGCGAGGGGCGCAGCCCCATCTTCACCCACCTGGTGACCTCCCTGAAA
CFTR-C046 AAGCAGCTGGAGAGCGAGGGGCGCAGCCCCATCTTCACCCACCTGGTGACCTCCCTGAAA
CFTR-C008 AAGCAGCTGGAGAGCGAGGGCAGGTCGCCCATATTCACCCACCTGGTGACCTCCCTCAAA
CFTR-C033 AAGCAGCTGGAGAGCGAGGGCAGGTCGCCCATATTCACCCACCTGGTGACCTCCCTCAAA
CFTR-C022 AAGCAGCTCGAGAGTGAAGGCCGCAGCCCCATCTTCACCCACCTTGTGACCAGCCTGAAG
CFTR-C047 AAGCAGCTCGAGAGTGAAGGCCGCAGCCCCATCTTCACCCACCTTGTGACCAGCCTGAAG
CFTR-C017 AAGCAACTGGAATCCGAGGGCAGGAGCCCGATCTTCACCCACCTCGTGACCTCCCTCAAA
CFTR-C042 AAGCAACTGGAATCCGAGGGCAGGAGCCCGATCTTCACCCACCTCGTGACCTCCCTCAAA
CFTR-C020 AAGCAACTGGAATCAGAGGGCAGGTCCCCCATCTTCACCCACCGGTGACCTCCCTCAAA
CFTR-C045 AAGCAACTGGAATCAGAGGGCAGGTCCCCCATCTTCACCCACCTGGTGACCTCCCTCAAA
CFTR-C013 AAGCAACTGGAGTCGGAGGGAAGGAGCCCCATCTTCACCCATCTGGTCACCAGCCTGAAA
CFTR-C038 AAGCAACTGGAGTCGGAGGGAAGGAGCCCCATCTTCACCCATCTGGTCACCAGCCTGAAA
CFTR-C002 AAGCAGCTGGAGAGCGAGGGCCGCAGCCCGATCTTCACCCACCTGGTCACCAGCCTGAAG
CFTR-C027 AAGCAGCTGGAGAGCGAGGGCCGCAGCCCGATCTTCACCCACCTGGTCACCAGCCTGAAG
CFTR-C011 AAGCAACTAGAATCCGAAGGGAGGAGCCCCATCTTCACCCATCTGGTGACCTCCCTCAAG
CFTR-C036 AAGCAACTAGAATCCGAAGGGAGGAGCCCCATCTTCACCCATCTGGTGACCTCCCTCAAG
CFTR-C005 AAGCAGCTCGAGAGCGAGGGCCGCTCCCCCATCTTCACCCACCTGGTGACCAGCCTGAAG
CFTR-C030 AAGCAGCTCGAGAGCGAGGGCCGCTCCCCCATCTTCACCCACCTGGTGACCAGCCTGAAG
CFTR-C006 AAGCAGCTCGAGTCAGAGGGCAGGTCCCCCATCTTCACCCACCTGGTGACCTCCCTGAAG
CFTR-C031 AAGCAGCTCGAGTCAGAGGGCAGGTCCCCCATCTTCACCCACCTGGTGACCTCCCTGAAG
CFTR-C018 AAGCAGCTGGAGTCCGAGGGGAGGAGCCCAATCTTTACCCACCTCGTGACCAGCCTGAAA
CFTR-C043 AAGCAGCTGGAGTCCGAGGGGAGGAGCCCAATCTTTACCCACCTCGTGACCAGCCTGAAA
CFTR-C003 AAGCAGCTGGAATCCGAAGGCAGGAGCCCCATCTTCACCCACCTGGTGACGTCCCTCAAG
CFTR-C028 AAGCAGCTGGAATCCGAAGGCAGGAGCCCCATCTTCACCCACCTGGTGACGTCCCTCAAG
CFTR-C016 AAGCAGCTCGAGTCCGAGGGCAGGAGCCCCATCTTTACCCACCTGGTGACGAGCCTGAAG
CFTR-C041 AAGCAGCTCGAGTCCGAGGGCAGGAGCCCCATCTTTACCCACCTGGTGACGAGCCTGAAG
CFTR-C010 AAGCAGCTGGAAAGCGAGGGCCGATCCCCCATCTTCACGCACCTGGTCACCTCCCTGAAG
CFTR-C035 AAGCAGCTGGAAAGCGAGGGCCGATCCCCCATCTTCACGCACCTGGTCACCTCCCTGAAG
CFTR-C012 AAGCAGCTGGAGAGCGAGGGGAGGAGCCCCATCTTCACCCATCTGGTGACCTCCCTGAAG
CFTR-C037 AAGCAGCTGGAGAGCGAGGGGAGGAGCCCCATCTTCACCCATCTGGTGACCTCCCTGAAG
CFTR-C009 AAGCAGCTGGAGAGCGAGGGCAGGAGCCCGATCTTTACCCACCTCGTGACCAGTCTGAAG
CFTR-C034 AAGCAGCTGGAGAGCGAGGGCAGGAGCCCGATCTTTACCCACCTCGTGACCAGTCTGAAG
CFTR-C015 AAGCAGCTGGAAAGCGAAGGAAGGAGCCCCATCTTCACCCACCTCGTTACATCACTCAAG
CFTR-C040 AAGCAGCTGGAAAGCGAAGGAAGGAGCCCCATCTTCACCCACCTCGTTACATCACTCAAG
CFTR-C019 AAGCAGCTGGAGAGCGAGGGGCGCAGCCCCATCTTCACCCACCTGGTCACCAGCCTGAAG
CFTR-C044 AAGCAGCTGGAGAGCGAGGGGCGCAGCCCCATCTTCACCCACCTGGTCACCAGCCTGAAG
CFTR-C007 AAGCAGCTGGAGTCGGAGGGGAGGAGCCCCATCTTTACCCACCTCGTGACCAGCCTGAAG
CFTR-C032 AAGCAGCTGGAGTCGGAGGGGAGGAGCCCCATCTTTACCCACCTCGTGACCAGCCTGAAG
CFTR-C014 AAGCAGCTCGAGAGCGAGGGCAGGAGCCCCATATTTACCCACCTGGTGACCAGCCTGAAG
CFTR-C039 AAGCAGCTCGAGAGCGAGGGCAGGAGCCCCATATTTACCCACCTGGTGACCAGCCTGAAG
CFTR-C025 AAGCAGCTCGAGAGCGAGGGCAGGTCCCCCATCTTCACACACCTGGTGACCAGCCTGAAA
CFTR-C050 AAGCAGCTCGAGAGCGAGGGCAGGTCCCCCATCTTCACACACCTGGTGACCAGCCTGAAA
CFTR-C023 AAGCAACTGGAGTCCGAGGGCCGGAGCCCCATCTTCACCCACCTCGTGACCAGCCTGAAA
CFTR-C048 AAGCAACTGGAGTCCGAGGGCCGGAGCCCCATCTTCACCCACCTCGTGACCAGCCTGAAA
CFTR-C024 AAGCAGCTGGAAAGCGAGGGCCGCAGCCCCATCTTCACCCACCTGGTGACCAGCCTAAAG
CFTR-C049 AAGCAGCTGGAAAGCGAGGGCCGCAGCCCCATCTTCACCCACCTGGTGACCAGCCTAAAG
```

FIG. 10 (cont)

```
CFTR-WT    GGACTATGGACACTTCGTGCCTTCGGACGGCAGCCTTACTTTGAAACTCTGTTCCACAAA
CFTR-C001  GGCCTGTGGACCCTGAGGGCCTTCGGCCGGCAGCCCTACTTCGAGACCTTGTTCCACAAG
CFTR-C026  GGCCTGTGGACCCTGAGGGCCTTCGGCCGGCAGCCCTACTTCGAGACCTTGTTCCACAAG
CFTR-C004  GGCCTGTGGACCCTGAGGGCCTTCGGCAGGCAGCCGTATTTGAAACCCTCTTCCACAAG
CFTR-C029  GGCCTGTGGACCCTGAGGGCCTTCGGCAGGCAGCCGTATTTGAAACCCTCTTCCACAAG
CFTR-C021  GGCCTGTGGACCCTCAGGGCCTTCGGGCGGCAGCCCTATTCGAGACCCTCTTTCACAAA
CFTR-C046  GGCCTGTGGACCCTCAGGGCCTTCGGGCGGCAGCCCTATTCGAGACCCTCTTTCACAAA
CFTR-C008  GGGCTGTGGACCCTGAGGGCCTTTGGCAGGCAACCCTACTTCGAGACGCTGTTCCACAAG
CFTR-C033  GGGCTGTGGACCCTGAGGGCCTTTGGCAGGCAACCCTACTTCGAGACGCTGTTCCACAAG
CFTR-C022  GGCCTGTGGACCCTGAGGGCCTTCGGGAGGCAACCCTACTTCGAGACGCTGTTTCACAAG
CFTR-C047  GGCCTGTGGACCCTGAGGGCCTTCGGGAGGCAACCCTACTTCGAGACGCTGTTTCACAAG
CFTR-C017  GGCCTCTGGACCCTGCGGGCCTTTGGGAGGCAGCCCTATTCGAGACCCTGTTCCACAAG
CFTR-C042  GGCCTCTGGACCCTGCGGGCCTTTGGGAGGCAGCCCTATTCGAGACCCTGTTCCACAAG
CFTR-C020  GGACTGTGGACCCTGAGGGCGTTCGGGCGCCAGCCCTACTTTGAGACCCTGTTCCACAAG
CFTR-C045  GGACTGTGGACCCTGAGGGCGTTCGGGCGCCAGCCCTACTTTGAGACCCTGTTCCACAAG
CFTR-C013  GGCCTGTGGACCCTGAGGGCCTTTGGCCGGCAGCCCTACTTCGAGACCCTGTTCCACAAG
CFTR-C038  GGCCTGTGGACCCTGAGGGCCTTTGGCCGGCAGCCCTACTTCGAGACCCTGTTCCACAAG
CFTR-C002  GGCCTCTGGACCCTGAGGGCCTTCGGCAGGCAACCTTACTTCGAGACCCTGTTCCACAAG
CFTR-C027  GGCCTCTGGACCCTGAGGGCCTTCGGCAGGCAACCTTACTTCGAGACCCTGTTCCACAAG
CFTR-C011  GGGCTGTGGACCCTGAGGGCCTTCGGCAGACAGCCCTACTTCGAGACCCTGTTCCACAAA
CFTR-C036  GGGCTGTGGACCCTGAGGGCCTTCGGCAGACAGCCCTACTTCGAGACCCTGTTCCACAAA
CFTR-C005  GGTCTCTGGACGCTGCGCGCCTTCGGCAGGCAACCCTACTTTGAGACCCTGTTTCACAAA
CFTR-C030  GGTCTCTGGACGCTGCGCGCCTTCGGCAGGCAACCCTACTTTGAGACCCTGTTTCACAAA
CFTR-C006  GGTCTCTGGACCCTGCGCGCTTTCGGGAGGCAGCCCTACTTCGAGACGCTGTTCCATAAA
CFTR-C031  GGTCTCTGGACCCTGCGCGCTTTCGGGAGGCAGCCCTACTTCGAGACGCTGTTCCATAAA
CFTR-C018  GGGCTGTGGACCCTGAGGGCCTTTGGGAGGCAACCCTATTTTGAGACCCTGTTTCACAAG
CFTR-C043  GGGCTGTGGACCCTGAGGGCCTTTGGGAGGCAACCCTATTTTGAGACCCTGTTTCACAAG
CFTR-C003  GGCCTGTGGACACTGCGCGCCTTCGGCAGGCAGCCGTACTTCGAGACCCTGTTCCACAAG
CFTR-C028  GGCCTGTGGACACTGCGCGCCTTCGGCAGGCAGCCGTACTTCGAGACCCTGTTCCACAAG
CFTR-C016  GGGCTCTGGACGCTGCGGGCGTTCGGCCGCCAGCCGTACTTCGAAACCCTGTTCCATAAG
CFTR-C041  GGGCTCTGGACGCTGCGGGCGTTCGGCCGCCAGCCGTACTTCGAAACCCTGTTCCATAAG
CFTR-C010  GGCCTGTGGACCCTGCGGGCATTCGGCAGGCAGCCGTACTTCGAGACCCTCTTCCACAAA
CFTR-C035  GGCCTGTGGACCCTGCGGGCATTCGGCAGGCAGCCGTACTTCGAGACCCTCTTCCACAAA
CFTR-C012  GGGCTGTGGACTCTCCGCGCCTTCGGCAGGCAGCCGTACTTCGAGACGCTGTTCCACAAG
CFTR-C037  GGGCTGTGGACTCTCCGCGCCTTCGGCAGGCAGCCGTACTTCGAGACGCTGTTCCACAAG
CFTR-C009  GGCCTGTGGACCCTGCGGGCCTTCGGACGGCAACCCTACTTCGAGACCCTGTTCCACAAG
CFTR-C034  GGCCTGTGGACCCTGCGGGCCTTCGGACGGCAACCCTACTTCGAGACCCTGTTCCACAAG
CFTR-C015  GGCCTGTGGACCCTGAGAGCCTTCGGGCGCCAGCCCTATTTGAGACGCTGTTCCACAAA
CFTR-C040  GGCCTGTGGACCCTGAGAGCCTTCGGGCGCCAGCCCTATTTGAGACGCTGTTCCACAAA
CFTR-C019  GGTCTGTGGACCCTGAGGGCCTTTGGCCGGCAGCCGTACTTCGAGACCCTGTTCCACAAA
CFTR-C044  GGTCTGTGGACCCTGAGGGCCTTTGGCCGGCAGCCGTACTTCGAGACCCTGTTCCACAAA
CFTR-C007  GGGCTGTGGACGCTCCGGGCCTTTGGCCGGCAGCCCTACTTTGAGACGCTGTTCCACAAG
CFTR-C032  GGGCTGTGGACGCTCCGGGCCTTTGGCCGGCAGCCCTACTTTGAGACGCTGTTCCACAAG
CFTR-C014  GGGCTGTGGACCCTGAGGGCCTTCGGCAGGCAGCCCTACTTCGAGACCCTGTTCCACAAG
CFTR-C039  GGGCTGTGGACCCTGAGGGCCTTCGGCAGGCAGCCCTACTTCGAGACCCTGTTCCACAAG
CFTR-C025  GGCCTGTGGACCCTGAGGGCCTTTGGCAGGCAACCCTACTTCGAAACACTCTTTCACAAA
CFTR-C050  GGCCTGTGGACCCTGAGGGCCTTTGGCAGGCAACCCTACTTCGAAACACTCTTTCACAAA
CFTR-C023  GGCCTGTGGACCCTGAGGGCCTTCGGCCGGCAACCCTATTTGAGACCCTGTTCACAAG
CFTR-C048  GGCCTGTGGACCCTGAGGGCCTTCGGCCGGCAACCCTATTTGAGACCCTGTTCACAAG
CFTR-C024  GGCCTGTGGACCCTCAGGGCCTTGGCCGCCAGCCTTACTTCGAAACCCTGTTCCACAAG
CFTR-C049  GGCCTGTGGACCCTCAGGGCCTTGGCCGCCAGCCTTACTTCGAAACCCTGTTCCACAAG
           ** ** ***** **   * ** **.**   *  **.** **.**.**.** .* **.**.**.
```

FIG. 10 (cont)

```
CFTR-WT   GCTCTGAATTTACATACTGCCAACTGGTTCTTGTACCTGTCAACACTGCGCTGGTTCCAA
CFTR-C001 GCGCTGAACCTGCACACCGCCAACTGGTTTCTGTACCTGAGCACCCTGCGGTGGTTCCAG
CFTR-C026 GCGCTGAACCTGCACACCGCCAACTGGTTTCTGTACCTGAGCACCCTGCGGTGGTTCCAG
CFTR-C004 GCCTTGAACCTGCATACTGCCAACTGGTTCCTGTACCTGAGCACCCTGCGGTGGTTCCAG
CFTR-C029 GCCTTGAACCTGCATACTGCCAACTGGTTCCTGTACCTGAGCACCCTGCGGTGGTTCCAG
CFTR-C021 GCCCTGAACCTGCACACTGCCAACTGGTTCCTGTATCTGAGCACCCTGCGCTGGTTCCAG
CFTR-C046 GCCCTGAACCTGCACACTGCCAACTGGTTCCTGTATCTGAGCACCCTGCGCTGGTTCCAG
CFTR-C008 GCCCTGAACCTGCACACAGCCAACTGGTTCCTGTACCTGAGCACGCTCCGCTGGTTCCAG
CFTR-C033 GCCCTGAACCTGCACACAGCCAACTGGTTCCTGTACCTGAGCACGCTCCGCTGGTTCCAG
CFTR-C022 GCCCTCAACCTCCACACCGCCAACTGGTTCCTCTACCTGAGCACCCTGCGCTGGTTCCAA
CFTR-C047 GCCCTCAACCTCCACACCGCCAACTGGTTCCTCTACCTGAGCACCCTGCGCTGGTTCCAA
CFTR-C017 GCCCTGAACCTCCACACCGCCAACTGGTTTCTGTACCTGTCGACGCTGCGGTGGTTCCAG
CFTR-C042 GCCCTGAACCTCCACACCGCCAACTGGTTTCTGTACCTGTCGACGCTGCGGTGGTTCCAG
CFTR-C020 GCCCTCAACCTGCACACCGCCAACTGGTTCCTGTATCTCTCCACCCTGCGGTGGTTCCAG
CFTR-C045 GCCCTCAACCTGCACACCGCCAACTGGTTCCTGTATCTCTCCACCCTGCGGTGGTTCCAG
CFTR-C013 GCCCTGAACCTGCATACCGCCAACTGGTTCCTGTACCTGTCCACCCTGCGGTGGTTCCAA
CFTR-C038 GCCCTGAACCTGCATACCGCCAACTGGTTCCTGTACCTGTCCACCCTGCGGTGGTTCCAA
CFTR-C002 GCCCTGAATCTCCACACCGCCAACTGGTTCCTCTATCTCAGCACCCTGAGGTGGTTCCAG
CFTR-C027 GCCCTGAATCTCCACACCGCCAACTGGTTCCTCTATCTCAGCACCCTGAGGTGGTTCCAG
CFTR-C011 GCCCTGAATCTGCACACCGCCAACTGGTTCCTCTACCTGTCAACCCTGAGGTGGTTCCAG
CFTR-C036 GCCCTGAATCTGCACACCGCCAACTGGTTCCTCTACCTGTCAACCCTGAGGTGGTTCCAG
CFTR-C005 GCCCTGAACCTGCACACCGCCAACTGGTTTCTGTACCTGTCCACCCTGAGGTGGTTCCAG
CFTR-C030 GCCCTGAACCTGCACACCGCCAACTGGTTTCTGTACCTGTCCACCCTGAGGTGGTTCCAG
CFTR-C006 GCCCTGAACCTGCACACCGCCAATTGGTTCCTCTACCTCTCCACCCTGCGGTGGTTCCAG
CFTR-C031 GCCCTGAACCTGCACACCGCCAATTGGTTCCTCTACCTCTCCACCCTGCGGTGGTTCCAG
CFTR-C018 GCCCTGAACCTCCACACCGCGAACTGGTTCCTCTATCTCAGCACCCTGAGGTGGTTCCAA
CFTR-C043 GCCCTGAACCTCCACACCGCGAACTGGTTCCTCTATCTCAGCACCCTGAGGTGGTTCCAA
CFTR-C003 GCCCTGAACTTACACACCGCGAATTGGTTCCTGTACCTGTCCACCCTGCGGTGGTTCCAG
CFTR-C028 GCCCTGAACTTACACACCGCGAATTGGTTCCTGTACCTGTCCACCCTGCGGTGGTTCCAG
CFTR-C016 GCCCTGAACCTGCACACCGCCAACTGGTTCCTCTACCTCTCCACCCTGCGGTGGTTCCAG
CFTR-C041 GCCCTGAACCTGCACACCGCCAACTGGTTCCTCTACCTCTCCACCCTGCGGTGGTTCCAG
CFTR-C010 GCCCTGAACCTGCACACAGCCAACTGGTTCCTCTACCTCAGCACCCTCCGGTGGTTTCAA
CFTR-C035 GCCCTGAACCTGCACACAGCCAACTGGTTCCTCTACCTCAGCACCCTCCGGTGGTTTCAA
CFTR-C012 GCCCTGAACCTCCACACCGCCAACTGGTTCCTTTATCTGAGCACCCTTCGGTGGTTCCAG
CFTR-C037 GCCCTGAACCTCCACACCGCCAACTGGTTCCTTTATCTGAGCACCCTTCGGTGGTTCCAG
CFTR-C009 GCCCTGAACCTGCACACAGCCAACTGGTTCCTGTACCTGAGCACCCTGAGGTGGTTCCAG
CFTR-C034 GCCCTGAACCTGCACACAGCCAACTGGTTCCTGTACCTGAGCACCCTGAGGTGGTTCCAG
CFTR-C015 GCCCTGAACTTGCATACCGCCAATTGGTTCCTCTACCTGAGCACCCTGCGGTGGTTTCAG
CFTR-C040 GCCCTGAACTTGCATACCGCCAATTGGTTCCTCTACCTGAGCACCCTGCGGTGGTTTCAG
CFTR-C019 GCCCTCAACCTGCATACCGCAAACTGGTTCCTCTACCTCTCCACCCTGCGGTGGTTCCAG
CFTR-C044 GCCCTCAACCTGCATACCGCAAACTGGTTCCTCTACCTCTCCACCCTGCGGTGGTTCCAG
CFTR-C007 GCCCTGAACCTGCATACCGCCAACTGGTTCTTGTACCTCAGCACTCTCCGATGGTTCCAG
CFTR-C032 GCCCTGAACCTGCATACCGCCAACTGGTTCTTGTACCTCAGCACTCTCCGATGGTTCCAG
CFTR-C014 GCACTGAACCTGCACACCGCCAACTGGTTTCTGTACCTGAGCACCCTGAGGTGGTTCCAG
CFTR-C039 GCACTGAACCTGCACACCGCCAACTGGTTTCTGTACCTGAGCACCCTGAGGTGGTTCCAG
CFTR-C025 GCCCTCAATCTGCACACCGCGAACTGGTTCCTGTACCTGTCCACCCTGAGGTGGTTCCAG
CFTR-C050 GCCCTCAATCTGCACACCGCGAACTGGTTCCTGTACCTGTCCACCCTGAGGTGGTTCCAG
CFTR-C023 GCCCTCAATCTCCATACCGCCAATTGGTTCCTCTACCTGAGCACCCTGAGGTGGTTTCAG
CFTR-C048 GCCCTCAATCTCCATACCGCCAATTGGTTCCTCTACCTGAGCACCCTGAGGTGGTTTCAG
CFTR-C024 GCCCTGAACCTCCACACCGCCAACTGGTTCCTGTACCTCTCCACCCTGAGGTGGTTCCAG
CFTR-C049 GCCCTGAACCTCCACACCGCCAACTGGTTCCTGTACCTCTCCACCCTGAGGTGGTTCCAG
          ** .* **..* **.** ** **.*****..* **.**    ** **  * *****.**.
```

FIG. 10 (cont)

| | |
|---|---|
| CFTR-WT | ATGAGAATAGAAATGATTTTTGTCATCTTCTTCATTGCTGTTACCTTCATTTCCATTTTA |
| CFTR-C001 | ATGAGGATCGAGATGATCTTCGTGATCTTCTTCATAGCCGTGACCTTCATCAGCATACTG |
| CFTR-C026 | ATGAGGATCGAGATGATCTTCGTGATCTTCTTCATAGCCGTGACCTTCATCAGCATACTG |
| CFTR-C004 | ATGAGGATCGAGATGATCTTCGTGATCTTCTTCATCGCCGTGACCTTTATCAGCATCCTG |
| CFTR-C029 | ATGAGGATCGAGATGATCTTCGTGATCTTCTTCATCGCCGTGACCTTTATCAGCATCCTG |
| CFTR-C021 | ATGAGGATCGAGATGATCTTCGTGATCTTCTTCATCGCCGTGACCTTTATCAGCATTCTC |
| CFTR-C046 | ATGAGGATCGAGATGATCTTCGTGATCTTCTTCATCGCCGTGACCTTTATCAGCATTCTC |
| CFTR-C008 | ATGAGGATCGAGATGATATTCGTGATTTTCTTCATAGCCGTGACCTTCATCAGCATCTTG |
| CFTR-C033 | ATGAGGATCGAGATGATATTCGTGATTTTCTTCATAGCCGTGACCTTCATCAGCATCTTG |
| CFTR-C022 | ATGAGGATAGAAATGATCTTCGTGATATTCTTCATCGCCGTGACCTTTATCAGCATACTG |
| CFTR-C047 | ATGAGGATAGAAATGATCTTCGTGATATTCTTCATCGCCGTGACCTTTATCAGCATACTG |
| CFTR-C017 | ATGCGCATCGAAATGATCTTCGTGATTTTCTTCATCGCCGTGACATTCATCAGCATTCTG |
| CFTR-C042 | ATGCGCATCGAAATGATCTTCGTGATTTTCTTCATCGCCGTGACATTCATCAGCATTCTG |
| CFTR-C020 | ATGCGGATCGAGATGATATTTGTCATCTTTTTCATCGCCGTGACCTTTATCAGCATCCTC |
| CFTR-C045 | ATGCGGATCGAGATGATATTTGTCATCTTTTTCATCGCCGTGACCTTTATCAGCATCCTC |
| CFTR-C013 | ATGAGGATCGAGATGATCTTCGTGATCTTCTTCATCGCCGTGACCTTCATCTCCATCCTT |
| CFTR-C038 | ATGAGGATCGAGATGATCTTCGTGATCTTCTTCATCGCCGTGACCTTCATCTCCATCCTT |
| CFTR-C002 | ATGAGGATCGAGATGATCTTTGTGATCTTCTTCATCGCCGTCACCTTCATCAGCATCCTG |
| CFTR-C027 | ATGAGGATCGAGATGATCTTTGTGATCTTCTTCATCGCCGTCACCTTCATCAGCATCCTG |
| CFTR-C011 | ATGCGCATAGAAATGATATTTGTGATATTCTTCATCGCCGTGACGTTCATCAGCATACTG |
| CFTR-C036 | ATGCGCATAGAAATGATATTTGTGATATTCTTCATCGCCGTGACGTTCATCAGCATACTG |
| CFTR-C005 | ATGCGGATCGAGATGATCTTCGTGATCTTTTTCATCGCCGTGACCTTCATCTCCATCCTG |
| CFTR-C030 | ATGCGGATCGAGATGATCTTCGTGATCTTTTTCATCGCCGTGACCTTCATCTCCATCCTG |
| CFTR-C006 | ATGCGCATCGAAATGATCTTCGTGATTTTCTTCATCGCCGTGACCTTTATCTCCATCCTC |
| CFTR-C031 | ATGCGCATCGAAATGATCTTCGTGATTTTCTTCATCGCCGTGACCTTTATCTCCATCCTC |
| CFTR-C018 | ATGCGGATCGAGATGATCTTTGTGATCTTCTTTATCGCCGTGACCTTCATCAGCATCCTG |
| CFTR-C043 | ATGCGGATCGAGATGATCTTTGTGATCTTCTTTATCGCCGTGACCTTCATCAGCATCCTG |
| CFTR-C003 | ATGCGGATTGAGATGATCTTCGTGATCTTCTTTATCGCCGTGACGTTTATATCCATCCTG |
| CFTR-C028 | ATGCGGATTGAGATGATCTTCGTGATCTTCTTTATCGCCGTGACGTTTATATCCATCCTG |
| CFTR-C016 | ATGCGGATCGAGATGATCTTCGTGATCTTCTTCATCGCCGTAACCTTCATCAGCATCCTG |
| CFTR-C041 | ATGCGGATCGAGATGATCTTCGTGATCTTCTTCATCGCCGTAACCTTCATCAGCATCCTG |
| CFTR-C010 | ATGAGAATCGAGATGATCTTTGTGATATTCTTCATCGCCGTGACGTTCATCAGCATCCTG |
| CFTR-C035 | ATGAGAATCGAGATGATCTTTGTGATATTCTTCATCGCCGTGACGTTCATCAGCATCCTG |
| CFTR-C012 | ATGCGTATCGAGATGATCTTCGTGATCTTCTTTATCGCCGTGACCTTTATCAGCATTCTG |
| CFTR-C037 | ATGCGTATCGAGATGATCTTCGTGATCTTCTTTATCGCCGTGACCTTTATCAGCATTCTG |
| CFTR-C009 | ATGAGGATCGAGATGATCTTTGTGATCTTCTTCATCGCCGTGACCTTCATTAGCATCCTG |
| CFTR-C034 | ATGAGGATCGAGATGATCTTTGTGATCTTCTTCATCGCCGTGACCTTCATTAGCATCCTG |
| CFTR-C015 | ATGCGCATCGAGATGATCTTCGTCATCTTCTTCATAGCGGTAACCTTTATTTCCATCCTG |
| CFTR-C040 | ATGCGCATCGAGATGATCTTCGTCATCTTCTTCATAGCGGTAACCTTTATTTCCATCCTG |
| CFTR-C019 | ATGCGGATCGAGATGATCTTCGTGATTTTCTTCATCGCCGTGACCTTTATCAGCATCCTG |
| CFTR-C044 | ATGCGGATCGAGATGATCTTCGTGATTTTCTTCATCGCCGTGACCTTTATCAGCATCCTG |
| CFTR-C007 | ATGCGCATCGAGATGATCTTTGTCATCTTCTTCATTGCCGTGACCTTTATAAGCATTCTG |
| CFTR-C032 | ATGCGCATCGAGATGATCTTTGTCATCTTCTTCATTGCCGTGACCTTTATAAGCATTCTG |
| CFTR-C014 | ATGAGGATCGAGATGATCTTCGTGATCTTCTTTATCGCCGTCACCTTCATCAGCATCCTG |
| CFTR-C039 | ATGAGGATCGAGATGATCTTCGTGATCTTCTTTATCGCCGTCACCTTCATCAGCATCCTG |
| CFTR-C025 | ATGAGGATCGAGATGATCTTCGTGATCTTCTTTATCGCCGTCACCTTCATCTCCATCCTG |
| CFTR-C050 | ATGAGGATCGAGATGATCTTCGTGATCTTCTTTATCGCCGTCACCTTCATCTCCATCCTG |
| CFTR-C023 | ATGCGTATCGAGATGATTTTCGTAATATTCTTCATCGCCGTGACCTTCATCTCCATCCTG |
| CFTR-C048 | ATGCGTATCGAGATGATTTTCGTAATATTCTTCATCGCCGTGACCTTCATCTCCATCCTG |
| CFTR-C024 | ATGCGGATCGAGATGATCTTCGTCATCTTTTTCATCGCCGTGACGTTCATCAGCATCCTG |
| CFTR-C049 | ATGCGGATCGAGATGATCTTCGTCATCTTTTTCATCGCCGTGACGTTCATCAGCATCCTG |
| | *** * ** **  *****  **  **  ** ** **  ** ** ** ** ** ,**     *** ,* |

FIG. 10 (cont)

| | |
|---|---|
| CFTR-WT | ACAACAGGAGAAGGAGAAGGAAGAGTTGGTATTATCCTGACTTTAGCCATGAATATCATG |
| CFTR-C001 | ACCACCGGGAAGGCGAGGGCAGGGTCGGCATCATCCTCACCCTGGCCATGAACATCATG |
| CFTR-C026 | ACCACCGGGAAGGCGAGGGCAGGGTCGGCATCATCCTCACCCTGGCCATGAACATCATG |
| CFTR-C004 | ACCACCGGCGAGGGTGAGGGCCGGGTGGGGATCATCCTCACCCTGGCCATGAACATAATG |
| CFTR-C029 | ACCACCGGCGAGGGTGAGGGCCGGGTGGGGATCATCCTCACCCTGGCCATGAACATAATG |
| CFTR-C021 | ACCACAGGAGAAGGGGAGGGCCGCGTGGGCATCATTCTCACACTCGCCATGAACATCATG |
| CFTR-C046 | ACCACAGGAGAAGGGGAGGGCCGCGTGGGCATCATTCTCACACTCGCCATGAACATCATG |
| CFTR-C008 | ACCACGGGCGAAGGCGAAGGCCGAGTCGGTATCATCCTGACGCTGGCCATGAACATCATG |
| CFTR-C033 | ACCACGGGCGAAGGCGAAGGCCGAGTCGGTATCATCCTGACGCTGGCCATGAACATCATG |
| CFTR-C022 | ACCACCGGCGAAGGCGAGGGCAGGGTCGGGATCATCCTGACCCTCGCCATGAACATCATG |
| CFTR-C047 | ACCACCGGCGAAGGCGAGGGCAGGGTCGGGATCATCCTGACCCTCGCCATGAACATCATG |
| CFTR-C017 | ACCACCGGCGAGGGCGAGGGGAGGGTGGGCATCATTCTGACCCTGGCAATGAACATCATG |
| CFTR-C042 | ACCACCGGCGAGGGCGAGGGGAGGGTGGGCATCATTCTGACCCTGGCAATGAACATCATG |
| CFTR-C020 | ACCACCGGCGAGGGCGAGGGCCGTGTCGGCATTATCCTGACCCTGGCAATGAACATCATG |
| CFTR-C045 | ACCACCGGCGAGGGCGAGGGCCGTGTCGGCATTATCCTGACCCTGGCAATGAACATCATG |
| CFTR-C013 | ACCACAGGCGAGGGCGAGGGCAGGGTAGGCATAATCCTGACCCTGGCCATGAACATCATG |
| CFTR-C038 | ACCACAGGCGAGGGCGAGGGCAGGGTAGGCATAATCCTGACCCTGGCCATGAACATCATG |
| CFTR-C002 | ACCACTGGCGAGGGTGAGGGGCGCGTGGGCATCATCCTCACCCTGGCCATGAACATAATG |
| CFTR-C027 | ACCACTGGCGAGGGTGAGGGGCGCGTGGGCATCATCCTCACCCTGGCCATGAACATAATG |
| CFTR-C011 | ACCACCGGGGAGGGAGAGGGGCGTGTGGGCATCATCCTGACCCTCGCGATGAACATTATG |
| CFTR-C036 | ACCACCGGGGAGGGAGAGGGGCGTGTGGGCATCATCCTGACCCTCGCGATGAACATTATG |
| CFTR-C005 | ACCACCGGGGAAGGGGAGGGACGGGTGGGCATCATCCTGACCCTCGCCATGAACATCATG |
| CFTR-C030 | ACCACCGGGGAAGGGGAGGGACGGGTGGGCATCATCCTGACCCTCGCCATGAACATCATG |
| CFTR-C006 | ACCACCGGAGAAGGGGAAGGCCGGGTGGGCATCATCCTGACACTCGCCATGAACATAATG |
| CFTR-C031 | ACCACCGGAGAAGGGGAAGGCCGGGTGGGCATCATCCTGACACTCGCCATGAACATAATG |
| CFTR-C018 | ACCACCGGGGAGGGCGAGGGCCGCGTCGGCATCATCCTGACCCTCGCCATGAACATCATG |
| CFTR-C043 | ACCACCGGGGAGGGCGAGGGCCGCGTCGGCATCATCCTGACCCTCGCCATGAACATCATG |
| CFTR-C003 | ACGACCGGGGAGGGGGAAGGCAGGGTGGGGATCATCCTCACCCTGGCCATGAACATCATG |
| CFTR-C028 | ACGACCGGGGAGGGGGAAGGCAGGGTGGGGATCATCCTCACCCTGGCCATGAACATCATG |
| CFTR-C016 | ACCACTGGCGAGGGCGAGGGCAGGGTGGGAATCATCCTCACCCTTGCCATGAATATCATG |
| CFTR-C041 | ACCACTGGCGAGGGCGAGGGCAGGGTGGGAATCATCCTCACCCTTGCCATGAATATCATG |
| CFTR-C010 | ACAACCGGCGAGGGAGAGGGTAGGGTGGGCATCATCCTGACCCTCGCCATGAACATCATG |
| CFTR-C035 | ACAACCGGCGAGGGAGAGGGTAGGGTGGGCATCATCCTGACCCTCGCCATGAACATCATG |
| CFTR-C012 | ACCACCGGAGAGGGGGAGGGGCGGGTGGGGATCATCCTGACGCTGGCCATGAATATCATG |
| CFTR-C037 | ACCACCGGAGAGGGGGAGGGGCGGGTGGGGATCATCCTGACGCTGGCCATGAATATCATG |
| CFTR-C009 | ACGACCGGAGAGGGCGAGGGCCGCGTCGGCATCATCCTGACCCTGGCCATGAATATCATG |
| CFTR-C034 | ACGACCGGAGAGGGCGAGGGCCGCGTCGGCATCATCCTGACCCTGGCCATGAATATCATG |
| CFTR-C015 | ACCACGGGCGAGGGCGAGGGCCGTGTGGGCATCATCCTGACCCTGGCCATGAACATAATG |
| CFTR-C040 | ACCACGGGCGAGGGCGAGGGCCGTGTGGGCATCATCCTGACCCTGGCCATGAACATAATG |
| CFTR-C019 | ACCACCGGTGAGGGCGAGGGGCGGGTCGGGATCATCCTGACCCTGGCCATGAACATCATG |
| CFTR-C044 | ACCACCGGTGAGGGCGAGGGGCGGGTCGGGATCATCCTGACCCTGGCCATGAACATCATG |
| CFTR-C007 | ACTACGGGTGAGGGGGAAGGCGCGTGGGGATCATCCTGACCCTGGCCATGAACATTATG |
| CFTR-C032 | ACTACGGGTGAGGGGGAAGGCGCGTGGGGATCATCCTGACCCTGGCCATGAACATTATG |
| CFTR-C014 | ACGACGGGCGAGGGCGAGGGCCGGGTTGGCATCATCCTGACCCTCGCCATGAACATCATG |
| CFTR-C039 | ACGACGGGCGAGGGCGAGGGCCGGGTTGGCATCATCCTGACCCTCGCCATGAACATCATG |
| CFTR-C025 | ACCACCGGCGAAGGCGAGGGCCGGGTGGGCATCATCCTGACCCTCGCCATGAACATCATG |
| CFTR-C050 | ACCACCGGCGAAGGCGAGGGCCGGGTGGGCATCATCCTGACCCTCGCCATGAACATCATG |
| CFTR-C023 | ACCACCGGCGAGGGAGAAGGCCGCGTGGGGATCATCCTGACCCTCGCCATGAACATCATG |
| CFTR-C048 | ACCACCGGCGAGGGAGAAGGCCGCGTGGGGATCATCCTGACCCTCGCCATGAACATCATG |
| CFTR-C024 | ACCACGGGCGAGGGGGAAGGCCGGGTTGGTATCATCCTGACCCTGGCCATGAACATCATG |
| CFTR-C049 | ACCACGGGCGAGGGGGAAGGCCGGGTTGGTATCATCCTGACCCTGGCCATGAACATCATG |
| | ** ** ** ** ** ** ** * ** ** ** ** ** * ** ***** ** *** |

FIG. 10 (cont)

```
CFTR-WT    AGTACATTGCAGTGGGCTGTAAACTCCAGCATAGATGTGGATAGCTTGATGCGATCTGTG
CFTR-C001  AGCACCCTGCAGTGGGCGGTGAACAGCTCCATCGATGTGGACAGCCTGATGAGGTCCGTG
CFTR-C026  AGCACCCTGCAGTGGGCGGTGAACAGCTCCATCGATGTGGACAGCCTGATGAGGTCCGTG
CFTR-C004  TCCACCCTGCAGTGGGCCGTGAACAGCAGCATCGACGTGGACAGCCTGATGAGGAGCGTG
CFTR-C029  TCCACCCTGCAGTGGGCCGTGAACAGCAGCATCGACGTGGACAGCCTGATGAGGAGCGTG
CFTR-C021  AGCACCTTGCAATGGGCCGTGAACAGCAGCATCGACGTGGACAGCCTGATGAGGAGCGTG
CFTR-C046  AGCACCTTGCAATGGGCCGTGAACAGCAGCATCGACGTGGACAGCCTGATGAGGAGCGTG
CFTR-C008  AGCACCCTGCAGTGGGCGGTCAATAGCAGCATCGACGTGGACTCCCTGATGAGGAGCGTG
CFTR-C033  AGCACCCTGCAGTGGGCGGTCAATAGCAGCATCGACGTGGACTCCCTGATGAGGAGCGTG
CFTR-C022  TCCACCCTGCAATGGGCCGTGAACTCCAGCATCGACGTGGACAGCCTGATGAGGAGCGTC
CFTR-C047  TCCACCCTGCAATGGGCCGTGAACTCCAGCATCGACGTGGACAGCCTGATGAGGAGCGTC
CFTR-C017  TCGACCCTGCAGTGGGCCGTGAACTCAAGCATCGACGTGGACAGCCTGATGAGGTCCGTT
CFTR-C042  TCGACCCTGCAGTGGGCCGTGAACTCAAGCATCGACGTGGACAGCCTGATGAGGTCCGTT
CFTR-C020  AGCACCCTGCAGTGGGCCGTGAATTCCTCCATCGACGTGGACAGCCTGATGAGGAGCGTC
CFTR-C045  AGCACCCTGCAGTGGGCCGTGAATTCCTCCATCGACGTGGACAGCCTGATGAGGAGCGTC
CFTR-C013  TCCACGCTGCAGTGGGCCGTCAACAGCAGCATCGACGTGGACAGCCTCATGAGGTCCGTG
CFTR-C038  TCCACGCTGCAGTGGGCCGTCAACAGCAGCATCGACGTGGACAGCCTCATGAGGTCCGTG
CFTR-C002  AGCACCCTGCAGTGGGCCGTGAATAGCAGCATCGACGTGGACTCACTGATGCGGTCCGTC
CFTR-C027  AGCACCCTGCAGTGGGCCGTGAATAGCAGCATCGACGTGGACTCACTGATGCGGTCCGTC
CFTR-C011  AGCACCCTGCAGTGGGCCGTGAACAGCTCCATCGACGTGGACAGCCTGATGCGCTCCGTG
CFTR-C036  AGCACCCTGCAGTGGGCCGTGAACAGCTCCATCGACGTGGACAGCCTGATGCGCTCCGTG
CFTR-C005  AGCACCCTACAGTGGGCCGTGAATAGCTCCATCGACGTCGACAGCCTCATGCGTAGCGTG
CFTR-C030  AGCACCCTACAGTGGGCCGTGAATAGCTCCATCGACGTCGACAGCCTCATGCGTAGCGTG
CFTR-C006  AGCACCCTGCAGTGGGCCGTGAACAGCAGCATCGACGTTGACAGCCTGATGAGGTCCGTG
CFTR-C031  AGCACCCTGCAGTGGGCCGTGAACAGCAGCATCGACGTTGACAGCCTGATGAGGTCCGTG
CFTR-C018  TCCACCCTCCAGTGGGCCGTGAATAGCAGCATCGACGTGGACAGCCTGATGAGGTCCGTG
CFTR-C043  TCCACCCTCCAGTGGGCCGTGAATAGCAGCATCGACGTGGACAGCCTGATGAGGTCCGTG
CFTR-C003  AGCACCCTGCAGTGGGCGGTGAACTCCAGCATCGACGTGGACAGCCTGATGCGATCAGTC
CFTR-C028  AGCACCCTGCAGTGGGCGGTGAACTCCAGCATCGACGTGGACAGCCTGATGCGATCAGTC
CFTR-C016  AGCACACTGCAGTGGGCCGTGAATAGCTCCATCGACGTGGACTCCCTGATGCGGTCCGTG
CFTR-C041  AGCACACTGCAGTGGGCCGTGAATAGCTCCATCGACGTGGACTCCCTGATGCGGTCCGTG
CFTR-C010  AGCACACTGCAATGGGCGGTGAACAGCAGCATCGACGTGGACTCCCTGATGCGGTCCGTC
CFTR-C035  AGCACACTGCAATGGGCGGTGAACAGCAGCATCGACGTGGACTCCCTGATGCGGTCCGTC
CFTR-C012  TCCACCCTGCAATGGGCCGTGAACTCCTCCATCGACGTGGATAGCCTGATGCGATCCGTC
CFTR-C037  TCCACCCTGCAATGGGCCGTGAACTCCTCCATCGACGTGGATAGCCTGATGCGATCCGTC
CFTR-C009  AGCACCCTGCAGTGGGCCGTGAATAGCTCCATCGACGTGGACAGCCTCATGCGAAGCGTG
CFTR-C034  AGCACCCTGCAGTGGGCCGTGAATAGCTCCATCGACGTGGACAGCCTCATGCGAAGCGTG
CFTR-C015  TCGACCCTGCAGTGGGCTGTGAACAGCAGCATCGACGTGGACAGCCTCATGAGGAGCGTG
CFTR-C040  TCGACCCTGCAGTGGGCTGTGAACAGCAGCATCGACGTGGACAGCCTCATGAGGAGCGTG
CFTR-C019  TCCACCCTGCAGTGGGCCGTCAACAGCTCCATCGACGTAGACAGCCTGATGAGGAGCGTC
CFTR-C044  TCCACCCTGCAGTGGGCCGTCAACAGCTCCATCGACGTAGACAGCCTGATGAGGAGCGTC
CFTR-C007  TCCACCCTGCAGTGGGCCGTGAACTCCTCCATTGACGTGGACAGCCTGATGCGGAGCGTG
CFTR-C032  TCCACCCTGCAGTGGGCCGTGAACTCCTCCATTGACGTGGACAGCCTGATGCGGAGCGTG
CFTR-C014  AGCACCCTCCAGTGGGCCGTGAACAGCAGCATCGACGTGGACAGCCTGATGCGGTCCGTC
CFTR-C039  AGCACCCTCCAGTGGGCCGTGAACAGCAGCATCGACGTGGACAGCCTGATGCGGTCCGTC
CFTR-C025  AGCACCCTGCAGTGGGCGGTGAACAGCTCCATCGACGTGGATTCCCTGATGAGATCCGTG
CFTR-C050  AGCACCCTGCAGTGGGCGGTGAACAGCTCCATCGACGTGGATTCCCTGATGAGATCCGTG
CFTR-C023  AGCACCCTGCAGTGGGCCGTGAACTCCAGCATCGACGTCGACTCCCTGATGCGCAGCGTG
CFTR-C048  AGCACCCTGCAGTGGGCCGTGAACTCCAGCATCGACGTCGACTCCCTGATGCGCAGCGTG
CFTR-C024  AGTACACTCCAATGGGCCGTGAACTCCAGCATCGACGTGGACAGCCTCATGAGGAGCGTG
CFTR-C049  AGTACACTCCAATGGGCCGTGAACTCCAGCATCGACGTGGACAGCCTCATGAGGAGCGTG
               **  ,* ** ,***** ** **,     *** **,** **,  ,* *** *    **
```

FIG. 10 (cont)

```
CFTR-WT    AGCCGAGTCTTTAAGTTCATTGACATGCCAACAGAAGGTAAACCTACCAAGTCAACCAAA
CFTR-C001  AGTCGGGTGTTCAAGTTCATCGACATGCCCACCGAGGGCAAACCTACCAAATCCACCAAA
CFTR-C026  AGTCGGGTGTTCAAGTTCATCGACATGCCCACCGAGGGCAAACCTACCAAATCCACCAAA
CFTR-C004  TCCCGGGTCTTCAAGTTTATCGACATGCCCACCGAGGGCAAGCCCACGAAGAGCACCAAG
CFTR-C029  TCCCGGGTCTTCAAGTTTATCGACATGCCCACCGAGGGCAAGCCCACGAAGAGCACCAAG
CFTR-C021  TCCCGCGTGTTTAAGTTCATCGACATGCCCGACCGAGGGCAAGCCCACCAAGAGCACCAAG
CFTR-C046  TCCCGCGTGTTTAAGTTCATCGACATGCCCGACCGAGGGCAAGCCCACCAAGAGCACCAAG
CFTR-C008  AGCCGCGTGTTTAAGTTTATCGATATGCCGACCGAGGGCAAGCCCACCAAGTCCACCAAG
CFTR-C033  AGCCGCGTGTTTAAGTTTATCGATATGCCGACCGAGGGCAAGCCCACCAAGTCCACCAAG
CFTR-C022  AGCCGCGTCTTCAAGTTCATCGACATGCCCACCGAGGGCAAGCCCACCAAGAGCACCAAG
CFTR-C047  AGCCGCGTCTTCAAGTTCATCGACATGCCCACCGAGGGCAAGCCCACCAAGAGCACCAAG
CFTR-C017  TCCAGGGTGTTTAAATTCATCGATATGCCCACCGAGGGCAAGCCCACCAAGAGCACCAAG
CFTR-C042  TCCAGGGTGTTTAAATTCATCGATATGCCCACCGAGGGCAAGCCCACCAAGAGCACCAAG
CFTR-C020  AGCAGGGTGTTCAAGTTCATCGACATGCCCACGGAGGGCAAGCCGACCAAGTCGACCAAG
CFTR-C045  AGCAGGGTGTTCAAGTTCATCGACATGCCCACGGAGGGCAAGCCGACCAAGTCGACCAAG
CFTR-C013  TCCAGGGTCTTCAAATTCATCGACATGCCCACCGAGGGGAAGCCCACCAAAAGCACCAAG
CFTR-C038  TCCAGGGTCTTCAAATTCATCGACATGCCCACCGAGGGGAAGCCCACCAAAAGCACCAAG
CFTR-C002  TCCAGGGTCTTCAAGTTTATCGACATGCCCACCGAGGGAAAGCCCACCAAGAGCACCAAG
CFTR-C027  TCCAGGGTCTTCAAGTTTATCGACATGCCCACCGAGGGAAAGCCCACCAAGAGCACCAAG
CFTR-C011  AGCAGGGTGTTTAAGTTCATCGACATGCCCACCGAGGGCAAGCCCACCAAGAGCACCAAG
CFTR-C036  AGCAGGGTGTTTAAGTTCATCGACATGCCCACCGAGGGCAAGCCCACCAAGAGCACCAAG
CFTR-C005  AGCAGGGTGTTCAAATTTATAGACATGCCCACCGAGGGGAAGCCCACCAAGAGCACCAAG
CFTR-C030  AGCAGGGTGTTCAAATTTATAGACATGCCCACCGAGGGGAAGCCCACCAAGAGCACCAAG
CFTR-C006  TCCCGGGTCTTCAAGTTCATCGACATGCCGACCGAGGGCAAGCCCACCAAAAGCACCAAA
CFTR-C031  TCCCGGGTCTTCAAGTTCATCGACATGCCGACCGAGGGCAAGCCCACCAAAAGCACCAAA
CFTR-C018  TCTCGAGTGTTCAAGTTTATCGACATGCCGACCGAGGGGAAGCCCACCAAGAGCACTAAG
CFTR-C043  TCTCGAGTGTTCAAGTTTATCGACATGCCGACCGAGGGGAAGCCCACCAAGAGCACTAAG
CFTR-C003  AGCCGGGTATTCAAGTTCATCGATATGCCGACCGAGGGGAAGCCCACCAAGAGCACCAAG
CFTR-C028  AGCCGGGTATTCAAGTTCATCGATATGCCGACCGAGGGGAAGCCCACCAAGAGCACCAAG
CFTR-C016  AGCCGAGTGTTCAAATTCATCGACATGCCCACCGAGGGGAAGCCAACTAAGTCCACCAAG
CFTR-C041  AGCCGAGTGTTCAAATTCATCGACATGCCCACCGAGGGGAAGCCAACTAAGTCCACCAAG
CFTR-C010  AGCAGGGTGTTCAAATTCATCGACATGCCAACCGAGGGCAAGCCAACCAAGAGCACCAAG
CFTR-C035  AGCAGGGTGTTCAAATTCATCGACATGCCAACCGAGGGCAAGCCAACCAAGAGCACCAAG
CFTR-C012  AGCAGGGTGTTTAAGTTCATCGACATGCCCACCGAGGGCAAGCCGACCAAGTCGACCAAG
CFTR-C037  AGCAGGGTGTTTAAGTTCATCGACATGCCCACCGAGGGCAAGCCGACCAAGTCGACCAAG
CFTR-C009  AGCAGGGTGTTCAAGTTTATAGACATGCCCACCGAGGGCAAGCCCACCAAGAGCACCAAA
CFTR-C034  AGCAGGGTGTTCAAGTTTATAGACATGCCCACCGAGGGCAAGCCCACCAAGAGCACCAAA
CFTR-C015  AGCAGGGTGTTCAAGTTCATTGACATGCCCACGGAGGGAAAGCCCACCAAAAGCACAAAA
CFTR-C040  AGCAGGGTGTTCAAGTTCATTGACATGCCCACGGAGGGAAAGCCCACCAAAAGCACAAAA
CFTR-C019  TCCAGGGTGTTCAAGTTCATCGACATGCCGACGGAGGGCAAGCCGACCAAATCCACGAAG
CFTR-C044  TCCAGGGTGTTCAAGTTCATCGACATGCCGACGGAGGGCAAGCCGACCAAATCCACGAAG
CFTR-C007  AGCCGAGTGTTCAAGTTCATAGATATGCCCACCGAGGGCAAGCCCACCAAGTCCACCAAG
CFTR-C032  AGCCGAGTGTTCAAGTTCATAGATATGCCCACCGAGGGCAAGCCCACCAAGTCCACCAAG
CFTR-C014  AGCCGCGTGTTCAAATTTATCGACATGCCCACCGAAGGTAAACCTACCAAGTCAACGAAG
CFTR-C039  AGCCGCGTGTTCAAATTTATCGACATGCCCACCGAAGGTAAACCTACCAAGTCAACGAAG
CFTR-C025  AGCCGGGTGTTCAAATTCATCGACATGCCCACCGAGGGGAAGCCCACCAAGAGCACGAAG
CFTR-C050  AGCCGGGTGTTCAAATTCATCGACATGCCCACCGAGGGGAAGCCCACCAAGAGCACGAAG
CFTR-C023  TCCGGGTGTTCAAGTTCATCGACATGCCAACTGAGGGCAAGCCCACCAAGAGCACGAAG
CFTR-C048  TCCGGGTGTTCAAGTTCATCGACATGCCAACTGAGGGCAAGCCCACCAAGAGCACGAAG
CFTR-C024  AGCAGGGTGTTTAAGTTCATTGACATGCCCACCGAAGGGAAACCCACCAAGAGCACCAAG
CFTR-C049  AGCAGGGTGTTTAAGTTCATTGACATGCCCACCGAAGGGAAACCCACCAAGAGCACCAAG
```

FIG. 10 (cont)

```
CFTR-WT    CCATACAAGAATGGCCAACTCTCGAAAGTTATGATTATTGAGAATTCACACGTGAAGAAA
CFTR-C001  CCCTACAAGAACGGGCAACTGAGCAAGGTGATGATAATCGAGAACAGCCACGTGAAGAAG
CFTR-C026  CCCTACAAGAACGGGCAACTGAGCAAGGTGATGATAATCGAGAACAGCCACGTGAAGAAG
CFTR-C004  CCTTACAAAAACGGACAGCTGTCCAAAGTGATGATCATCGAGAACTCCCACGTCAAAAAG
CFTR-C029  CCTTACAAAAACGGACAGCTGTCCAAAGTGATGATCATCGAGAACTCCCACGTCAAAAAG
CFTR-C021  CCCTATAAGAACGGCCAGCTGAGCAAGGTGATGATCATCGAGAACAGCCACGTCAAGAAG
CFTR-C046  CCCTATAAGAACGGCCAGCTGAGCAAGGTGATGATCATCGAGAACAGCCACGTCAAGAAG
CFTR-C008  CCCTACAAAAACGGCCAGCTGAGTAAGGTTATGATCATAGAGAACAGCCACGTGAAGAAG
CFTR-C033  CCCTACAAAAACGGCCAGCTGAGTAAGGTTATGATCATAGAGAACAGCCACGTGAAGAAG
CFTR-C022  CCCTACAAGAACGGCCAGCTGAGCAAGGTTATGATCATCGAGAACAGCCACGTCAAGAAA
CFTR-C047  CCCTACAAGAACGGCCAGCTGAGCAAGGTTATGATCATCGAGAACAGCCACGTCAAGAAA
CFTR-C017  CCCTATAAAAACGGCCAGCTCTCCAAAGTGATGATCATCGAAAACAGCCACGTGAAGAAA
CFTR-C042  CCCTATAAAAACGGCCAGCTCTCCAAAGTGATGATCATCGAAAACAGCCACGTGAAGAAA
CFTR-C020  CCCTACAAGAACGGCCAACTGAGCAAGGTGATGATCATCGAAAACAGCCATGTGAAGAAG
CFTR-C045  CCCTACAAGAACGGCCAACTGAGCAAGGTGATGATCATCGAAAACAGCCATGTGAAGAAG
CFTR-C013  CCCTACAAGAATGGACAGCTGAGCAAGGTGATGATCATCGAGAACAGCCATGTGAAGAAA
CFTR-C038  CCCTACAAGAATGGACAGCTGAGCAAGGTGATGATCATCGAGAACAGCCATGTGAAGAAA
CFTR-C002  CCGTACAAGAACGGCCAGCTGAGCAAGGTGATGATCATCGAGAACAGCCATGTAAAGAAA
CFTR-C027  CCGTACAAGAACGGCCAGCTGAGCAAGGTGATGATCATCGAGAACAGCCATGTAAAGAAA
CFTR-C011  CCCTATAAGAACGGCCAGCTCTCCAAGGTGATGATCATCGAGAACTCCCACGTGAAGAAA
CFTR-C036  CCCTATAAGAACGGCCAGCTCTCCAAGGTGATGATCATCGAGAACTCCCACGTGAAGAAA
CFTR-C005  CCCTATAAAAATGGGCAACTGTCCAAAGTCATGATCATAGAAAACAGCCACGTGAAGAAA
CFTR-C030  CCCTATAAAAATGGGCAACTGTCCAAAGTCATGATCATAGAAAACAGCCACGTGAAGAAA
CFTR-C006  CCTTACAAGAACGGGCAGCTCAGCAAGGTGATGATCATCGAGAACAGCCACGTGAAGAAG
CFTR-C031  CCTTACAAGAACGGGCAGCTCAGCAAGGTGATGATCATCGAGAACAGCCACGTGAAGAAG
CFTR-C018  CCCTACAAGAACGGGCAGCTGTCCAAGGTGATGATCATAGAAAACAGCCACGTGAAGAAG
CFTR-C043  CCCTACAAGAACGGGCAGCTGTCCAAGGTGATGATCATAGAAAACAGCCACGTGAAGAAG
CFTR-C003  CCCTACAAGAACGGGCAGCTGTCCAAGGTGATGATCATCGAGAACAGCCACGTGAAGAAG
CFTR-C028  CCCTACAAGAACGGGCAGCTGTCCAAGGTGATGATCATCGAGAACAGCCACGTGAAGAAG
CFTR-C016  CCGTACAAGAACGGCCAGCTGAGCAAAGTGATGATCATCGAGAACAGCCATGTGAAGAAG
CFTR-C041  CCGTACAAGAACGGCCAGCTGAGCAAAGTGATGATCATCGAGAACAGCCATGTGAAGAAG
CFTR-C010  CCGTACAAGAATGGCCAACTCAGCAAGGTGATGATCATCGAAAACAGCCACGTGAAAAAG
CFTR-C035  CCGTACAAGAATGGCCAACTCAGCAAGGTGATGATCATCGAAAACAGCCACGTGAAAAAG
CFTR-C012  CCGTACAAGAACGGTCAGCTGTCCAAGGTCATGATCATAGAAAACTCCCACGTGAAGAAG
CFTR-C037  CCGTACAAGAACGGTCAGCTGTCCAAGGTCATGATCATAGAAAACTCCCACGTGAAGAAG
CFTR-C009  CCCTACAAGAACGGGCAGCTCTCCAAGGTTATGATCATCGAGAATAGCCATGTGAAGAAG
CFTR-C034  CCCTACAAGAACGGGCAGCTCTCCAAGGTTATGATCATCGAGAATAGCCATGTGAAGAAG
CFTR-C015  CCCTACAAGAATGGCCAACTAAGCAAAGTCATGATCATCGAGAACTCCCACGTGAAAAAG
CFTR-C040  CCCTACAAGAATGGCCAACTAAGCAAAGTCATGATCATCGAGAACTCCCACGTGAAAAAG
CFTR-C019  CCCTACAAGAACGGCCAGCTCAGCAAAGTGATGATCATCGAGAACTCCCACGTGAAGAAG
CFTR-C044  CCCTACAAGAACGGCCAGCTCAGCAAAGTGATGATCATCGAGAACTCCCACGTGAAGAAG
CFTR-C007  CCCTATAAGAACGGCCAGCTGAGCAAGGTGATGATCATCGAGAACAGCCACGTGAAGAAG
CFTR-C032  CCCTATAAGAACGGCCAGCTGAGCAAGGTGATGATCATCGAGAACAGCCACGTGAAGAAG
CFTR-C014  CCCTATAAGAACGGCCAGCTGAGCAAGGTCATGATCATTGAGAATTCCCACGTGAAGAAG
CFTR-C039  CCCTATAAGAACGGCCAGCTGAGCAAGGTCATGATCATTGAGAATTCCCACGTGAAGAAG
CFTR-C025  CCCTACAAGAACGGCCAACTGAGCAAGGTGATGATCATCGAGAATTCTCACGTGAAGAAG
CFTR-C050  CCCTACAAGAACGGCCAACTGAGCAAGGTGATGATCATCGAGAATTCTCACGTGAAGAAG
CFTR-C023  CCATATAAGAACGGGCAACTGAGCAAGGTGATGATCATCGAGAACAGCCACGTCAAGAAG
CFTR-C048  CCATATAAGAACGGGCAACTGAGCAAGGTGATGATCATCGAGAACAGCCACGTCAAGAAG
CFTR-C024  CCCTACAAGAACGGTCAGCTGAGCAAGGTGATGATTATCGAGAATTCCCACGTGAAGAAG
CFTR-C049  CCCTACAAGAACGGTCAGCTGAGCAAGGTGATGATTATCGAGAATTCCCACGTGAAGAAG
           ** **.**.**.** **.**     **.** ***** ** **.**.    **.** **.**.
```

FIG. 10 (cont)

| | |
|---|---|
| CFTR-WT | GATGACATCTGGCCCTCAGGGGGCCAAATGACTGTCAAAGATCTCACAGCAAAATACACA |
| CFTR-C001 | GACGACATCTGGCCCTCCGGCGGGCAGATGACCGTGAAAGACCTGACCGCCAAGTACACC |
| CFTR-C026 | GACGACATCTGGCCCTCCGGCGGGCAGATGACCGTGAAAGACCTGACCGCCAAGTACACC |
| CFTR-C004 | GACGACATCTGGCCCAGCGGTGGCCAGATGACCGTTAAGGACCTCACCGCCAAGTACACC |
| CFTR-C029 | GACGACATCTGGCCCAGCGGTGGCCAGATGACCGTTAAGGACCTCACCGCCAAGTACACC |
| CFTR-C021 | GACGACATATGGCCAAGCGGCGGACAGATGACCGTGAAGGACCTGACCGCCAAGTACACG |
| CFTR-C046 | GACGACATATGGCCAAGCGGCGGACAGATGACCGTGAAGGACCTGACCGCCAAGTACACG |
| CFTR-C008 | GACGACATCTGGCCCAGCGGCGGCCAGATGACCGTGAAGGACCTGACCGCCAAGTATACC |
| CFTR-C033 | GACGACATCTGGCCCAGCGGCGGCCAGATGACCGTGAAGGACCTGACCGCCAAGTATACC |
| CFTR-C022 | GACGATATATGGCCCAGCGGCGGCCAGATGACCGTCAAGGACCTGACCGCCAAGTACACC |
| CFTR-C047 | GACGATATATGGCCCAGCGGCGGCCAGATGACCGTCAAGGACCTGACCGCCAAGTACACC |
| CFTR-C017 | GACGACATCTGGCCCAGCGGGGGCAGATGACCGTGAAGGACCTGACTGCCAAGTACACC |
| CFTR-C042 | GACGACATCTGGCCCAGCGGGGGCAGATGACCGTGAAGGACCTGACTGCCAAGTACACC |
| CFTR-C020 | GACGACATCTGGCCCAGCGGGGGCCAGATGACCGTGAAGGACCTGACTGCCAAGTACACC |
| CFTR-C045 | GACGACATCTGGCCCAGCGGGGGCCAGATGACCGTGAAGGACCTGACTGCCAAGTACACC |
| CFTR-C013 | GACGATATCTGGCCGAGTGGGGGCCAGATGACCGTGAAGGACCTGACCGCCAAGTACACC |
| CFTR-C038 | GACGATATCTGGCCGAGTGGGGGCCAGATGACGGTGAAGGACCTGACCGCCAAGTACACC |
| CFTR-C002 | GACGACATCTGGCCTTCCGGCGGGCAGATGACCGTGAAAGACCTGACCGCCAAGTATACC |
| CFTR-C027 | GACGACATCTGGCCTTCCGGCGGGCAGATGACCGTGAAAGACCTGACCGCCAAGTATACC |
| CFTR-C011 | GACGATATCTGGCCCAGCGGCGGCCAGATGACCGTGAAGGATCTGACCGCCAAGTACACC |
| CFTR-C036 | GACGATATCTGGCCCAGCGGCGGCCAGATGACCGTGAAGGATCTGACCGCCAAGTACACC |
| CFTR-C005 | GACGACATCTGGCCCAGCGGCGGCCAGATGACCGTCAAGGACCTGACCGCCAAGTACACC |
| CFTR-C030 | GACGACATCTGGCCCAGCGGCGGCCAGATGACCGTCAAGGACCTGACCGCCAAGTACACC |
| CFTR-C006 | GACGACATCTGGCCCAGCGGAGGGCAGATGACAGTGAAAGATCTTACCGCCAAGTACACC |
| CFTR-C031 | GACGACATCTGGCCCAGCGGAGGGCAGATGACAGTGAAAGATCTTACCGCCAAGTACACC |
| CFTR-C018 | GACGATATCTGGCCGTCCGGCGGCCAGATGACCGTGAAGGACCTGACCGCGAAGTATACG |
| CFTR-C043 | GACGATATCTGGCCGTCCGGCGGCCAGATGACCGTGAAGGACCTGACCGCGAAGTATACG |
| CFTR-C003 | GACGACATCTGGCCCTCCGGCGGTCAGATGACCGTGAAGGACCTGACCGCCAAGTACACC |
| CFTR-C028 | GACGACATCTGGCCCTCCGGCGGTCAGATGACCGTGAAGGACCTGACCGCCAAGTACACC |
| CFTR-C016 | GACGATATTTGGCCCAGCGGGGGCCAGATGACCGTTAAAGACCTGACCGCCAAGTATACC |
| CFTR-C041 | GACGATATTTGGCCCAGCGGGGGCCAGATGACCGTTAAAGACCTGACCGCCAAGTATACC |
| CFTR-C010 | GACGACATCTGGCCCTCCGGCGGGCAGATGACCGTGAAGGACCTGACCGCGAAGTACACC |
| CFTR-C035 | GACGACATCTGGCCCTCCGGCGGGCAGATGACCGTGAAGGACCTGACCGCGAAGTACACC |
| CFTR-C012 | GATGACATCTGGCCCTCCGGCGGCCAGATGACCGTGAAGGACCTGACCGCCAAGTACACC |
| CFTR-C037 | GATGACATCTGGCCCTCCGGCGGCCAGATGACCGTGAAGGACCTGACCGCCAAGTACACC |
| CFTR-C009 | GACGATATCTGGCCGTCCGGCGGCCAGATGACCGTGAAGGACCTCACCGCAAAGTACACC |
| CFTR-C034 | GACGATATCTGGCCGTCCGGCGGCCAGATGACCGTGAAGGACCTCACCGCAAAGTACACC |
| CFTR-C015 | GACGACATCTGGCCCTCCGGCGGACAGATGACCGTGAAGGACCTGACCGCCAAGTACACC |
| CFTR-C040 | GACGACATCTGGCCCTCCGGCGGACAGATGACCGTGAAGGACCTGACCGCCAAGTACACC |
| CFTR-C019 | GACGATATCTGGCCCAGCGGCGGACAGATGACCGTGAAGGACCTGACGGCCAAGTACACC |
| CFTR-C044 | GACGATATCTGGCCCAGCGGCGGACAGATGACCGTGAAGGACCTGACGGCCAAGTACACC |
| CFTR-C007 | GACGACATATGGCCGAGCGGGGGCCAGATGACCGTGAAGGACCTGACCGCCAAGTACACC |
| CFTR-C032 | GACGACATATGGCCGAGCGGGGGCCAGATGACCGTGAAGGACCTGACCGCCAAGTACACC |
| CFTR-C014 | GACGACATCTGGCCAAGCGGGGGCCAGATGACCGTGAAGGATCTGACCGCCAAGTACACC |
| CFTR-C039 | GACGACATCTGGCCAAGCGGGGGCCAGATGACCGTGAAGGATCTGACCGCCAAGTACACC |
| CFTR-C025 | GACGACATCTGGCCCAGCGGCGGACAGATGACCGTGAAAGACCTGACCGCCAAGTACACT |
| CFTR-C050 | GACGACATCTGGCCCAGCGGCGGACAGATGACCGTGAAAGACCTGACCGCCAAGTACACT |
| CFTR-C023 | GACGATATCTGGCCCAGCGGGGGCCAGATGACCGTGAAGGACCTCACCGCCAAATATACC |
| CFTR-C048 | GACGATATCTGGCCCAGCGGGGGCCAGATGACCGTGAAGGACCTCACCGCCAAATATACC |
| CFTR-C024 | GACGACATCTGGCCCTCCGGAGGCCAGATGACCGTGAAGGACCTCACCGCCAAATACACG |
| CFTR-C049 | GACGACATCTGGCCCTCCGGAGGCCAGATGACCGTGAAGGACCTCACCGCCAAATACACG |
| | \*\*.\*\*.\*\* \*\*\*\*\*   \*\* \*\* \*\*.\*\*\*\*\* .\*\* .\*\*.\*\*.\*\* \*\* \*\* \*\*.\*\*.\*\* |

FIG. 10 (cont)

```
CFTR-WT    GAAGGTGGAAATGCCATATTAGAGAACATTTCCTTCTCAATAAGTCCTGGCCAGAGGGTG
CFTR-C001  GAGGGCGGCAATGCCATCCTGGAGAACATCAGCTTCAGCATCTCCCCGGGTCAGAGGGTG
CFTR-C026  GAGGGCGGCAATGCCATCCTGGAGAACATCAGCTTCAGCATCTCCCCGGGTCAGAGGGTG
CFTR-C004  GAGGGCGGAAACGCCATCCTGGAGAACATCAGCTTCTCCATCTCCCCGGGACAGCGCGTG
CFTR-C029  GAGGGCGGAAACGCCATCCTGGAGAACATCAGCTTCTCCATCTCCCCGGGACAGCGCGTG
CFTR-C021  GAGGGAGGCAACGCGATCCTGGAGAACATCAGCTTCAGCATCTCCCCGGCCAGCGCGTG
CFTR-C046  GAGGGAGGCAACGCGATCCTGGAGAACATCAGCTTCAGCATCTCCCCGGCCAGCGCGTG
CFTR-C008  GAGGGTGGCAACGCCATCCTGGAGAACATCTCCTTCAGCATCTCTCCGGCCAGCGGGTG
CFTR-C033  GAGGGTGGCAACGCCATCCTGGAGAACATCTCCTTCAGCATCTCTCCGGCCAGCGGGTG
CFTR-C022  GAAGGCGGCAACGCCATCCTGGAGAACATCAGCTTCAGCATTAGCCCCGGCCAGCGAGTG
CFTR-C047  GAAGGCGGCAACGCCATCCTGGAGAACATCAGCTTCAGCATTAGCCCCGGCCAGCGAGTG
CFTR-C017  GAGGGGGGCAACGCCATCCTGGAAAACATCAGCTTTTCCATCAGCCCCGGCCAGAGGGTC
CFTR-C042  GAGGGGGGCAACGCCATCCTGGAAAACATCAGCTTTTCCATCAGCCCCGGCCAGAGGGTC
CFTR-C020  GAGGGGGGCAATGCCATACTGGAGAACATCAGCTTCTCCATCAGCCCTGGACAGAGGGTC
CFTR-C045  GAGGGGGGCAATGCCATACTGGAGAACATCAGCTTCTCCATCAGCCCTGGACAGAGGGTC
CFTR-C013  GAGGGCGGCAACGCGATCCTGGAGAACATTAGCTTCAGCATCTCTCCGGACAGCGGGTC
CFTR-C038  GAGGGCGGCAACGCGATCCTGGAGAACATTAGCTTCAGCATCTCTCCGGACAGCGGGTC
CFTR-C002  GAAGGCGGCAACGCCATCCTGGAGAACATAAGCTTTAGCATCAGCCCCGGCCAGAGGGTG
CFTR-C027  GAAGGCGGCAACGCCATCCTGGAGAACATAAGCTTTAGCATCAGCCCCGGCCAGAGGGTG
CFTR-C011  GAGGGAGGGAACGCCATCCTCGAGAACATCTCCTTCAGCATCAGCCCCGGCCAGAGGGTG
CFTR-C036  GAGGGAGGGAACGCCATCCTCGAGAACATCTCCTTCAGCATCAGCCCCGGCCAGAGGGTG
CFTR-C005  GAGGGAGGCAATGCCATCCTGGAGAACATCAGCTTTAGCATCAGCCCCGGCCAGAGAGTG
CFTR-C030  GAGGGAGGCAATGCCATCCTGGAGAACATCAGCTTTAGCATCAGCCCCGGCCAGAGAGTG
CFTR-C006  GAAGGCGGCAATGCCATCCTGGAAAATATAAGCTTCAGCATCAGCCCCGGCCAGAGGGTC
CFTR-C031  GAAGGCGGCAATGCCATCCTGGAAAATATAAGCTTCAGCATCAGCCCCGGCCAGAGGGTC
CFTR-C018  GAGGGCGGCAACGCCATCCTCGAGAACATAAGCTTCAGCATAAGCCCCGGCCAGCGAGTG
CFTR-C043  GAGGGCGGCAACGCCATCCTCGAGAACATAAGCTTCAGCATAAGCCCCGGCCAGCGAGTG
CFTR-C003  GAAGGCGGCAACGCCATCCTGGAGAACATCAGCTTCTCCATCAGCCCGGGGCAAAGGGTG
CFTR-C028  GAAGGCGGCAACGCCATCCTGGAGAACATCAGCTTCTCCATCAGCCCGGGGCAAAGGGTG
CFTR-C016  GAGGGGGGAACGCCATTCTGGAGAACATCAGCTTCTCCATCAGCCCCGGGCAGCGGGTG
CFTR-C041  GAGGGGGGAACGCCATTCTGGAGAACATCAGCTTCTCCATCAGCCCCGGGCAGCGGGTG
CFTR-C010  GAGGGGGGAAACGCCATCCTGGAGAATATCTCCTTCAGTATCAGCCCGGGCCAGAGGGTC
CFTR-C035  GAGGGGGGAAACGCCATCCTGGAGAATATCTCCTTCAGTATCAGCCCGGGCCAGAGGGTC
CFTR-C012  GAGGGCGGGAACGCTATCCTGGAGAACATCTCCTTCAGCATCTCCCCGGCCAGAGGGTG
CFTR-C037  GAGGGCGGGAACGCTATCCTGGAGAACATCTCCTTCAGCATCTCCCCGGCCAGAGGGTG
CFTR-C009  GAGGGCGGGAACGCAATCCTCGAGAACATCAGCTTCAGCATCTCCCCGGGCAGCGGGTG
CFTR-C034  GAGGGCGGGAACGCAATCCTCGAGAACATCAGCTTCAGCATCTCCCCGGGCAGCGGGTG
CFTR-C015  GAGGGCGGCAACGCAATACTGGAGAACATCAGCTTCTCGATATCCCCGGCCAGCGCGTG
CFTR-C040  GAGGGCGGCAACGCAATACTGGAGAACATCAGCTTCTCGATATCCCCGGCCAGCGCGTG
CFTR-C019  GAAGGCGGCAACGCTATACTGGAAAACATCAGCTTCAGCATTAGCCCGGGGCAGAGGGTG
CFTR-C044  GAAGGCGGCAACGCTATACTGGAAAACATCAGCTTCAGCATTAGCCCGGGGCAGAGGGTG
CFTR-C007  GAGGGGGGAATGCCATCCTGGAGAACATCAGCTTCTCCATCTCCCCGGCCAAAGGGTG
CFTR-C032  GAGGGGGGAATGCCATCCTGGAGAACATCAGCTTCTCCATCTCCCCGGCCAAAGGGTG
CFTR-C014  GAGGGGGGAACGCCATCCTGGAGAACATCAGCTTTAGCATCTCCCCGGGCAGAGGGTG
CFTR-C039  GAGGGGGGAACGCCATCCTGGAGAACATCAGCTTTAGCATCTCCCCGGGCAGAGGGTG
CFTR-C025  GAGGGCGGGAACGCCATCCTTGAGAACATAAGCTTCAGCATCAGCCCCGGTCAGAGGGTG
CFTR-C050  GAGGGCGGGAACGCCATCCTTGAGAACATAAGCTTCAGCATCAGCCCCGGTCAGAGGGTG
CFTR-C023  GAGGGGGGTAACGCCATCCTGGAGAACATCAGCTTCTCCATCAGTCCCGGGCAGCGGGTC
CFTR-C048  GAGGGGGGTAACGCCATCCTGGAGAACATCAGCTTCTCCATCAGTCCCGGGCAGCGGGTC
CFTR-C024  GAGGGCGGCAACGCCATCCTGGAGAACATCAGCTTCTCCATCTCGCCCGGACAGAGGGTT
CFTR-C049  GAGGGCGGCAACGCCATCCTGGAGAACATCAGCTTCTCCATCTCGCCCGGACAGAGGGTT
           **.** ** **.** ** .* **.**.**   ***.   **    ** ** **. * **
```

FIG. 10 (cont)

```
CFTR-WT    GGCCTCTTGGGAAGAACTGGATCAGGGAAGAGTACTTTGTTATCAGCTTTTTTGAGACTA
CFTR-C001  GGCCTGCTGGGGCGCACCGGCTCCGGCAAGAGCACCCTGCTGAGCGCGTTCCTGAGACTG
CFTR-C026  GGCCTGCTGGGGCGCACCGGCTCCGGCAAGAGCACCCTGCTGAGCGCGTTCCTGAGACTG
CFTR-C004  GGCCTGCTGGGGCGCACCGGCAGCGGAAAGAGCACCCTGCTGTCCGCCTTCCTGCGCCTG
CFTR-C029  GGCCTGCTGGGGCGCACCGGCAGCGGAAAGAGCACCCTGCTGTCCGCCTTCCTGCGCCTG
CFTR-C021  GGCCTGCTCGGCAGGACCGGCAGCGGCAAGAGCACCCTACTCTCCGCGTTTCTGCGGCTG
CFTR-C046  GGCCTGCTCGGCAGGACCGGCAGCGGCAAGAGCACCCTACTCTCCGCGTTTCTGCGGCTG
CFTR-C008  GGCCTGCTCGGACGGACCGGAAGCGGCAAGAGCACCCTGCTGTCCGCCTTTCTGCGGCTG
CFTR-C033  GGCCTGCTCGGACGGACCGGAAGCGGCAAGAGCACCCTGCTGTCCGCCTTTCTGCGGCTG
CFTR-C022  GGCCTGCTCGGAAGGACCGGCAGCGGAAGAGCACCCTGCTGAGCGCGTTTCTGAGGCTG
CFTR-C047  GGCCTGCTCGGAAGGACCGGCAGCGGAAGAGCACCCTGCTGAGCGCGTTTCTGAGGCTG
CFTR-C017  GGGCTGCTGGGGAGGACCGGGAGCGGCAAGAGCACCCTCCTGAGCGCGTTCCTGCGGCTG
CFTR-C042  GGGCTGCTGGGGAGGACCGGGAGCGGCAAGAGCACCCTCCTGAGCGCGTTCCTGCGGCTG
CFTR-C020  GGCCTGCTGGGGCGGACCGGTTCGGGCAAGAGCACCCTTCTGAGCGCCTTCCTGCGACTG
CFTR-C045  GGCCTGCTGGGGCGGACCGGTTCGGGCAAGAGCACCCTTCTGAGCGCCTTCCTGCGACTG
CFTR-C013  GGGCTGCTCGGCCGAACCGGAAGCGGGAAGTCCACACTGCTGTCCGCGTTCCTGCGTCTG
CFTR-C038  GGGCTGCTCGGCCGAACCGGAAGCGGGAAGTCCACACTGCTGTCCGCGTTCCTGCGTCTG
CFTR-C002  GGTCTGCTGGGCCGCACGGGCAGCGGAAAAAGCACCCTCCTGTCCGCGTTCCTGCGGCTG
CFTR-C027  GGTCTGCTGGGCCGCACGGGCAGCGGAAAAAGCACCCTCCTGTCCGCGTTCCTGCGGCTG
CFTR-C011  GGCCTGCTGGGCCGGACCGGGTCCGGCAAGTCAACGCTGCTGAGCGCCTTCCTGAGACTC
CFTR-C036  GGCCTGCTGGGCCGGACCGGGTCCGGCAAGTCAACGCTGCTGAGCGCCTTCCTGAGACTC
CFTR-C005  GGCCTACTGGGCCGGACCGGCAGCGGCAAGTCCACCCTGCTGAGCGCCTTCCTGCGTCTG
CFTR-C030  GGCCTACTGGGCCGGACCGGCAGCGGCAAGTCCACCCTGCTGAGCGCCTTCCTGCGTCTG
CFTR-C006  GGCCTGCTGGGCAGGACCGGATCCGGGAAGAGCACCCTGCTGTCCGCCTTTCTGCGCCTG
CFTR-C031  GGCCTGCTGGGCAGGACCGGATCCGGGAAGAGCACCCTGCTGTCCGCCTTTCTGCGCCTG
CFTR-C018  GGTCTGCTGGGCAGGACCGGGAGCGGCAAGAGCACCCTGCTGAGCGCCTTCCTCCGTCTG
CFTR-C043  GGTCTGCTGGGCAGGACCGGGAGCGGCAAGAGCACCCTGCTGAGCGCCTTCCTCCGTCTG
CFTR-C003  GGGCTGCTGGGGAGGACCGGCAGCGGCAAAAGCACGCTGCTGTCTGCCTTCCTGAGGCTC
CFTR-C028  GGGCTGCTGGGGAGGACCGGCAGCGGCAAAAGCACGCTGCTGTCTGCCTTCCTGAGGCTC
CFTR-C016  GGCCTGCTGGGCCGGACCGGCAGCGGGAAGTCCACACTCCTGTCCGCCTTCCTGAGGCTG
CFTR-C041  GGCCTGCTGGGCCGGACCGGCAGCGGGAAGTCCACACTCCTGTCCGCCTTCCTGAGGCTG
CFTR-C010  GGACTCCTGGGCAGGACCGGCAGCGGCAAGTCCACCCTGCTGTCAGCCTTCCTGCGCCTG
CFTR-C035  GGACTCCTGGGCAGGACCGGCAGCGGCAAGTCCACCCTGCTGTCAGCCTTCCTGCGCCTG
CFTR-C012  GGCTTGCTCGGGAGGACCGGCAGCGGTAAGAGCACCCTGCTGTCCGCCTTCCTGAGGCTG
CFTR-C037  GGCTTGCTCGGGAGGACCGGCAGCGGTAAGAGCACCCTGCTGTCCGCCTTCCTGAGGCTG
CFTR-C009  GGCTTGCTTGGGCGCACAGGCAGCGGAAAGAGCACCCTGCTGAGCGCCTTCTTGCGACTG
CFTR-C034  GGCTTGCTTGGGCGCACAGGCAGCGGAAAGAGCACCCTGCTGAGCGCCTTCTTGCGACTG
CFTR-C015  GGCCTGCTTGGCAGGACCGGCAGCGGAAAGAGCACCCTGCTCAGCGCTTTCCTGAGGCTC
CFTR-C040  GGCCTGCTTGGCAGGACCGGCAGCGGAAAGAGCACCCTGCTCAGCGCTTTCCTGAGGCTC
CFTR-C019  GGCCTGCTGGGCCGGACCGGAAGCGGCAAGAGCACCCTGCTGTCCGCCTTCCTGCGGCTG
CFTR-C044  GGCCTGCTGGGCCGGACCGGAAGCGGCAAGAGCACCCTGCTGTCCGCCTTCCTGCGGCTG
CFTR-C007  GGCCTCCTGGGCAGGACCGGCAGCGGCAAAAGCACTCTGCTCTCCGCCTTCCTGCGGCTG
CFTR-C032  GGCCTCCTGGGCAGGACCGGCAGCGGCAAAAGCACTCTGCTCTCCGCCTTCCTGCGGCTG
CFTR-C014  GGGCTGCTGGGCCGAACCGGGAGCGGCAAGAGCACCCTGCTGAGCGCCTTCCTACGCCTG
CFTR-C039  GGGCTGCTGGGCCGAACCGGGAGCGGCAAGAGCACCCTGCTGAGCGCCTTCCTACGCCTG
CFTR-C025  GGCCTCCTGGGCCGGACGGGCAGCGGGAAGTCCACCCTGCTGTCCGCCTTCCTGCGGCTG
CFTR-C050  GGCCTCCTGGGCCGGACGGGCAGCGGGAAGTCCACCCTGCTGTCCGCCTTCCTGCGGCTG
CFTR-C023  GGCCTGCTCGGCCGAACCGGCAGCGGGAAGAGCACGCTGCTCTCCGCGTTCCTGCGGCTG
CFTR-C048  GGCCTGCTCGGCCGAACCGGCAGCGGGAAGAGCACGCTGCTCTCCGCGTTCCTGCGGCTG
CFTR-C024  GGCCTGCTGGGCCGGACCGGGAGCGGCAAATCGACCCTCCTGAGCGCCTTCCTGAGGCTC
CFTR-C049  GGCCTGCTGGGCCGGACCGGGAGCGGCAAATCGACCCTCCTGAGCGCCTTCCTGAGGCTC
           ** .*..*.**. *.** **.       ** .**.  .**..* .*.    ** **..*. * **
```

FIG. 10 (cont)

| | |
|---|---|
| CFTR-WT | CTGAACACTGAAGGAGAAATCCAGATCGATGGTGTGTCTTGGGATTCAATAACTTTGCAA |
| CFTR-C001 | CTGAACACCGAGGGCGAGATTCAAATCGACGGTGTGAGCTGGGATAGCATCACGCTGCAG |
| CFTR-C026 | CTGAACACCGAGGGCGAGATTCAAATCGACGGTGTGAGCTGGGATAGCATCACGCTGCAG |
| CFTR-C004 | CTGAACACCGAGGGGGAGATCCAGATTGACGGCGTGAGCTGGGACAGCATCACGCTGCAG |
| CFTR-C029 | CTGAACACCGAGGGGGAGATCCAGATTGACGGCGTGAGCTGGGACAGCATCACGCTGCAG |
| CFTR-C021 | CTGAACACCGAGGGCGAAATCCAGATCGACGGAGTGAGCTGGGACAGCATCACCCTGCAG |
| CFTR-C046 | CTGAACACCGAGGGCGAAATCCAGATCGACGGAGTGAGCTGGGACAGCATCACCCTGCAG |
| CFTR-C008 | CTCAACACCGAGGGCGAGATCCAAATCGACGGTGTGAGCTGGGATAGCATCACGCTGCAG |
| CFTR-C033 | CTCAACACCGAGGGCGAGATCCAAATCGACGGTGTGAGCTGGGATAGCATCACGCTGCAG |
| CFTR-C022 | TTGAACACCGAGGGCGAAATCCAGATCGATGGCGTGAGCTGGGACAGCATCACCCTCCAA |
| CFTR-C047 | TTGAACACCGAGGGCGAAATCCAGATCGATGGCGTGAGCTGGGACAGCATCACCCTCCAA |
| CFTR-C017 | CTGAACACCGAGGGCGAGATACAGATCGACGGGGTATCGTGGGACAGCATCACCCTGCAG |
| CFTR-C042 | CTGAACACCGAGGGCGAGATACAGATCGACGGGGTATCGTGGGACAGCATCACCCTGCAG |
| CFTR-C020 | CTTAACACCGAAGGCGAGATTCAGATAGACGGCGTCAGCTGGGACTCCATCACCCTCCAG |
| CFTR-C045 | CTTAACACCGAAGGCGAGATTCAGATAGACGGCGTCAGCTGGGACTCCATCACCCTCCAG |
| CFTR-C013 | CTGAATACCGAGGGGGAGATCCAAATCGACGGCGTGAGCTGGGACAGCATCACCCTGCAG |
| CFTR-C038 | CTGAATACCGAGGGGGAGATCCAAATCGACGGCGTGAGCTGGGACAGCATCACCCTGCAG |
| CFTR-C002 | CTGAATACCGAGGGCGAGATCCAGATCGACGGAGTCAGCTGGGACTCCATCACCCTGCAG |
| CFTR-C027 | CTGAATACCGAGGGCGAGATCCAGATCGACGGAGTCAGCTGGGACTCCATCACCCTGCAG |
| CFTR-C011 | CTCAACACCGAGGGCGAGATACAGATCGACGGGGTGAGCTGGGACTCCATCACCCTGCAA |
| CFTR-C036 | CTCAACACCGAGGGCGAGATACAGATCGACGGGGTGAGCTGGGACTCCATCACCCTGCAA |
| CFTR-C005 | CTGAATACCGAGGGCGAAATCCAGATCGACGGCGTGTCCTGGGACAGCATAACCCTGCAG |
| CFTR-C030 | CTGAATACCGAGGGCGAAATCCAGATCGACGGCGTGTCCTGGGACAGCATAACCCTGCAG |
| CFTR-C006 | CTGAACACCGAGGGGGAGATACAAATCGACGGCGTGTCCTGGGACAGCATCACCCTGCAG |
| CFTR-C031 | CTGAACACCGAGGGGGAGATACAAATCGACGGCGTGTCCTGGGACAGCATCACCCTGCAG |
| CFTR-C018 | CTGAACACCGAGGGGGAAATCCAAATCGACGGCGTGAGCTGGGACAGCATCACCCTCCAG |
| CFTR-C043 | CTGAACACCGAGGGGGAAATCCAAATCGACGGCGTGAGCTGGGACAGCATCACCCTCCAG |
| CFTR-C003 | CTGAACACCGAGGGCGAGATCCAGATCGACGGCGTGTCCTGGGACAGCATCACCCTGCAG |
| CFTR-C028 | CTGAACACCGAGGGCGAGATCCAGATCGACGGCGTGTCCTGGGACAGCATCACCCTGCAG |
| CFTR-C016 | CTCAATACGGAGGGCGAAATACAGATCGACGGCGTGAGCTGGGACTCAATCACGCTGCAG |
| CFTR-C041 | CTCAATACGGAGGGCGAAATACAGATCGACGGCGTGAGCTGGGACTCAATCACGCTGCAG |
| CFTR-C010 | CTGAACACGGAGGGCGAGATCCAGATAGACGGGGTGTCATGGATAGCATCACCCTGCAG |
| CFTR-C035 | CTGAACACGGAGGGCGAGATCCAGATAGACGGGGTGTCATGGATAGCATCACCCTGCAG |
| CFTR-C012 | CTGAACACCGAGGGCGAAATCCAGATAGATGGCGTGAGCTGGGACTCCATCACCCTCCAG |
| CFTR-C037 | CTGAACACCGAGGGCGAAATCCAGATAGATGGCGTGAGCTGGGACTCCATCACCCTCCAG |
| CFTR-C009 | CTCAACACCGAGGGGGAGATCCAGATCGACGGCGTCTCATGGGACTCCATCACGCTGCAG |
| CFTR-C034 | CTCAACACCGAGGGGGAGATCCAGATCGACGGCGTCTCATGGGACTCCATCACGCTGCAG |
| CFTR-C015 | CTGAATACCGAGGGCGAGATACAGATAGATGGCGTGAGCTGGGACTCCATCACCCTGCAG |
| CFTR-C040 | CTGAATACCGAGGGCGAGATACAGATAGATGGCGTGAGCTGGGACTCCATCACCCTGCAG |
| CFTR-C019 | CTGAACACCGAGGGGGAAATACAGATAGACGGCGTGAGCTGGGACAGCATCACCCTGCAG |
| CFTR-C044 | CTGAACACCGAGGGGGAAATACAGATAGACGGCGTGAGCTGGGACAGCATCACCCTGCAG |
| CFTR-C007 | CTGAACACCGAGGGCGAGATCCAGATAGACGGCGTGAGCTGGGACTCCATCACCCTCCAA |
| CFTR-C032 | CTGAACACCGAGGGCGAGATCCAGATAGACGGCGTGAGCTGGGACTCCATCACCCTCCAA |
| CFTR-C014 | CTCAACACCGAGGGCGAAATCCAGATCGACGGCGTCTCCTGGGACAGCATCACCCTGCAG |
| CFTR-C039 | CTCAACACCGAGGGCGAAATCCAGATCGACGGCGTCTCCTGGGACAGCATCACCCTGCAG |
| CFTR-C025 | CTCAACACCGAGGGCGAGATCCAGATAGATGGCGTAAGCTGGGACAGCATCACCCTGCAG |
| CFTR-C050 | CTCAACACCGAGGGCGAGATCCAGATAGATGGCGTAAGCTGGGACAGCATCACCCTGCAG |
| CFTR-C023 | CTGAACACCGAGGGCGAGATTCAGATCGACGGGTCTCCTGGGATAGCATTACCCTGCAG |
| CFTR-C048 | CTGAACACCGAGGGCGAGATTCAGATCGACGGGTCTCCTGGGATAGCATTACCCTGCAG |
| CFTR-C024 | CTCAACACCGAGGGCGAGATCCAGATCGACGGAGTAAGCTGGGACTCCATCACGCTGCAG |
| CFTR-C049 | CTCAACACCGAGGGCGAGATCCAGATCGACGGAGTAAGCTGGGACTCCATCACGCTGCAG |

FIG. 10 (cont)

| | |
|---|---|
| CFTR-WT | CAGTGGAGGAAAGCCTTTGGAGTGATACCACAGAAAGTATTTATTTTTCTGGAACATTT |
| CFTR-C001 | CAGTGGAGGAAGGCATTCGGGGTGATCCCGCAAAAAGTATTCATATTCAGCGGCACCTTT |
| CFTR-C026 | CAGTGGAGGAAGGCATTCGGGGTGATCCCGCAAAAAGTATTCATATTCAGCGGCACCTTT |
| CFTR-C004 | CAGTGGCGGAAGGCTTTCGGGGTGATCCCCCAGAAGGTGTTCATCTTCTCCGGCACCTTC |
| CFTR-C029 | CAGTGGCGGAAGGCTTTCGGGGTGATCCCCCAGAAGGTGTTCATCTTCTCCGGCACCTTC |
| CFTR-C021 | CAATGGAGGAAGGCCTTCGGGGTGATCCCCCAGAAGGTGTTCATCTTCAGCGGTACCTTC |
| CFTR-C046 | CAATGGAGGAAGGCCTTCGGGGTGATCCCCCAGAAGGTGTTCATCTTCAGCGGTACCTTC |
| CFTR-C008 | CAGTGGCGGAAGGCCTTCGGCGTGATCCCGCAAAAGGTGTTCATTTTAGCGGCACCTTT |
| CFTR-C033 | CAGTGGCGGAAGGCCTTCGGCGTGATCCCGCAAAAGGTGTTCATTTTAGCGGCACCTTT |
| CFTR-C022 | CAGTGGAGGAAGGCCTTCGGCGTGATTCCCCAGAAGGTGTTCATCTTTAGCGGCACCTTC |
| CFTR-C047 | CAGTGGAGGAAGGCCTTCGGCGTGATTCCCCAGAAGGTGTTCATCTTTAGCGGCACCTTC |
| CFTR-C017 | CAGTGGCGGAAGGCCTTCGGCGTGATCCCCCAGAAGGTGTTTATATTCAGCGGCACCTTC |
| CFTR-C042 | CAGTGGCGGAAGGCCTTCGGCGTGATCCCCCAGAAGGTGTTTATATTCAGCGGCACCTTC |
| CFTR-C020 | CAGTGGAGGAAGGCCTTTGGGGTGATCCCCCAGAAGGTGTTCATCTTCAGCGGAACCTTC |
| CFTR-C045 | CAGTGGAGGAAGGCCTTTGGGGTGATCCCCCAGAAGGTGTTCATCTTCAGCGGAACCTTC |
| CFTR-C013 | CAGTGGCGGAAGGCCTTCGGCGTCATCCCCCAGAAGGTGTTCATCTTTAGCGGGACCTTT |
| CFTR-C038 | CAGTGGCGGAAGGCCTTCGGCGTCATCCCCCAGAAGGTGTTCATCTTTAGCGGGACCTTT |
| CFTR-C002 | CAGTGGAGGAAGGCCTTTGGTGTGATCCCCCAGAAGGTGTTCATCTTCAGCGGCACCTTT |
| CFTR-C027 | CAGTGGAGGAAGGCCTTTGGTGTGATCCCCCAGAAGGTGTTCATCTTCAGCGGCACCTTT |
| CFTR-C011 | CAGTGGCGTAAAGCTTTCGGGGTCATCCCCAGAAGGTGTTCATCTTCAGCGGCACATTC |
| CFTR-C036 | CAGTGGCGTAAAGCTTTCGGGGTCATCCCCAGAAGGTGTTCATCTTCAGCGGCACATTC |
| CFTR-C005 | CAATGGCGGAAGGCCTTCGGAGTGATCCCCCAGAAGGTGTTCATCTTCAGCGGGACGTTC |
| CFTR-C030 | CAATGGCGGAAGGCCTTCGGAGTGATCCCCCAGAAGGTGTTCATCTTCAGCGGGACGTTC |
| CFTR-C006 | CAATGGAGGAAAGCCTTCGGGGTTATCCCCCAGAAAGTGTTCATTTTTCCGGACCTTC |
| CFTR-C031 | CAATGGAGGAAAGCCTTCGGGGTTATCCCCCAGAAAGTGTTCATTTTTCCGGACCTTC |
| CFTR-C018 | CAGTGGCGCAAGGCCTTCGGCGTGATCCCCCAGAAGGTCTTCATCTTCTCCGGCACCTTC |
| CFTR-C043 | CAGTGGCGCAAGGCCTTCGGCGTGATCCCCCAGAAGGTCTTCATCTTCTCCGGCACCTTC |
| CFTR-C003 | CAGTGGCGGAAGGCCTTTGGCGTGATCCCGCAAAAGGTCTTCATCTTCAGCGGTACGTTT |
| CFTR-C028 | CAGTGGCGGAAGGCCTTTGGCGTGATCCCGCAAAAGGTCTTCATCTTCAGCGGTACGTTT |
| CFTR-C016 | CAGTGGAGGAAGGCATTCGGGGTCATCCCGCAGAAGGTGTTCATCTTTTCCGGCACCTTC |
| CFTR-C041 | CAGTGGAGGAAGGCATTCGGGGTCATCCCGCAGAAGGTGTTCATCTTTTCCGGCACCTTC |
| CFTR-C010 | CAGTGGAGGAAGGCCTTCGGGGTCATCCCCCAGAAGGTGTTCATCTTCTCCGGTACCTTC |
| CFTR-C035 | CAGTGGAGGAAGGCCTTCGGGGTCATCCCCCAGAAGGTGTTCATCTTCTCCGGTACCTTC |
| CFTR-C012 | CAGTGGAGGAAGGCCTTCGGCGTGATCCCCCAGAAGGTCTTTATTTTCAGCGGCACCTTT |
| CFTR-C037 | CAGTGGAGGAAGGCCTTCGGCGTGATCCCCCAGAAGGTCTTTATTTTCAGCGGCACCTTT |
| CFTR-C009 | CAGTGGCGGAAGGCCTTCGGGGTGATCCCCCAGAAGGTCTTCATCTTTTCCGGCACCTTC |
| CFTR-C034 | CAGTGGCGGAAGGCCTTCGGGGTGATCCCCCAGAAGGTCTTCATCTTTTCCGGCACCTTC |
| CFTR-C015 | CAGTGGCGGAAGGCCTTCGGCGTGATCCCGCAGAAGGTCTTCATCTTCTCCGGCACCTTT |
| CFTR-C040 | CAGTGGCGGAAGGCCTTCGGCGTGATCCCGCAGAAGGTCTTCATCTTCTCCGGCACCTTT |
| CFTR-C019 | CAATGGCGGAAGGCCTTCGGCGTCATCCCCCAAAAGGTCTTCATCTTCTCCGGCACCTTT |
| CFTR-C044 | CAATGGCGGAAGGCCTTCGGCGTCATCCCCCAAAAGGTCTTCATCTTCTCCGGCACCTTT |
| CFTR-C007 | CAGTGGCGCAAGGCGTTCGGCGTGATCCCCCAGAAAGTGTTCATTTTCAGCGGCACCTTC |
| CFTR-C032 | CAGTGGCGCAAGGCGTTCGGCGTGATCCCCCAGAAAGTGTTCATTTTCAGCGGCACCTTC |
| CFTR-C014 | CAGTGGCGCAAGGCCTTCGGCGTCATTCCCCAGAAGGTGTTTATCTTTAGTGGCACCTTC |
| CFTR-C039 | CAGTGGCGCAAGGCCTTCGGCGTCATTCCCCAGAAGGTGTTTATCTTTAGTGGCACCTTC |
| CFTR-C025 | CAATGGCGTAAGGCGTTCGGCGTGATACCGCAGAAGGTATTCATCTTCAGCGGGACCTTC |
| CFTR-C050 | CAATGGCGTAAGGCGTTCGGCGTGATACCGCAGAAGGTATTCATCTTCAGCGGGACCTTC |
| CFTR-C023 | CAGTGGCGGAAGGCGTTCGGCGTCATCCCCCAGAAGGTGTTCATCTTCTCGGGCACGTTC |
| CFTR-C048 | CAGTGGCGGAAGGCGTTCGGCGTCATCCCCCAGAAGGTGTTCATCTTCTCGGGCACGTTC |
| CFTR-C024 | CAGTGGCGAAAGGCGTTCGGGGTAATCCCTCAGAAGGTCTTCATCTTCAGCGGCACTTTC |
| CFTR-C049 | CAGTGGCGAAAGGCGTTCGGGGTAATCCCTCAGAAGGTCTTCATCTTCAGCGGCACTTTC |

FIG. 10 (cont)

```
CFTR-WT    AGAAAAAACTTGGATCCCTATGAACAGTGGAGTGATCAAGAAATATGGAAAGTTGCAGAT
CFTR-C001  CGCAAGAACCTGGACCCCTACGAGCAGTGGTCCGACCAGGAGATATGGAAGGTTGCCGAC
CFTR-C026  CGCAAGAACCTGGACCCCTACGAGCAGTGGTCCGACCAGGAGATATGGAAGGTTGCCGAC
CFTR-C004  CGGAAGAATCTGGACCCCTACGAGCAGTGGAGCGACCAGGAGATCTGGAAGGTGGCCGAT
CFTR-C029  CGGAAGAATCTGGACCCCTACGAGCAGTGGAGCGACCAGGAGATCTGGAAGGTGGCCGAT
CFTR-C021  AGGAAAAACCTGGATCCCTACGAGCAGTGGAGCGACCAAGAGATCTGGAAGGTGGCCGAC
CFTR-C046  AGGAAAAACCTGGATCCCTACGAGCAGTGGAGCGACCAAGAGATCTGGAAGGTGGCCGAC
CFTR-C008  AGGAAGAATCTGGATCCGTACGAGCAGTGGAGCGACCAGGAGATCTGGAAGGTGGCCGAC
CFTR-C033  AGGAAGAATCTGGATCCGTACGAGCAGTGGAGCGACCAGGAGATCTGGAAGGTGGCCGAC
CFTR-C022  AGGAAGAACCTCGACCCCTACGAGCAGTGGAGCGACCAAGAGATCTGGAAGGTTGCCGAC
CFTR-C047  AGGAAGAACCTCGACCCCTACGAGCAGTGGAGCGACCAAGAGATCTGGAAGGTTGCCGAC
CFTR-C017  CGAAAGAACCTGGACCCCTACGAGCAGTGGAGCGACCAGGAGATCTGGAAGGTGGCCGAC
CFTR-C042  CGAAAGAACCTGGACCCCTACGAGCAGTGGAGCGACCAGGAGATCTGGAAGGTGGCCGAC
CFTR-C020  CGTAAGAACCTGGACCCATACGAGCAGTGGAGCGACCAAGAGATCTGGAAGGTGGCGGAC
CFTR-C045  CGTAAGAACCTGGACCCATACGAGCAGTGGAGCGACCAAGAGATCTGGAAGGTGGCGGAC
CFTR-C013  AGGAAGAACCTGGATCCCTATGAGCAGTGGAGCGACCAAGAGATCTGGAAGGTGGCCGAT
CFTR-C038  AGGAAGAACCTGGATCCCTATGAGCAGTGGAGCGACCAAGAGATCTGGAAGGTGGCCGAT
CFTR-C002  CGCAAGAACCTGGACCCCTATGAGCAATGGAGCGACCAGGAGATCTGGAAGGTGGCCGAT
CFTR-C027  CGCAAGAACCTGGACCCCTATGAGCAATGGAGCGACCAGGAGATCTGGAAGGTGGCCGAT
CFTR-C011  CGGAAGAACCTGGACCCCTATGAGCAGTGGTCCGACCAGGAGATCTGGAAGGTGGCCGAT
CFTR-C036  CGGAAGAACCTGGACCCCTATGAGCAGTGGTCCGACCAGGAGATCTGGAAGGTGGCCGAT
CFTR-C005  AGGAAGAACCTGGACCCCTACGAGCAATGGAGCGACCAGGAGATATGGAAGGTGGCGGAC
CFTR-C030  AGGAAGAACCTGGACCCCTACGAGCAATGGAGCGACCAGGAGATATGGAAGGTGGCGGAC
CFTR-C006  AGGAAAAACCTGGACCCCTACGAGCAGTGGAGCGACCAGGAAATCTGGAAGGTGGCGGAC
CFTR-C031  AGGAAAAACCTGGACCCCTACGAGCAGTGGAGCGACCAGGAAATCTGGAAGGTGGCGGAC
CFTR-C018  AGGAAGAACCTCGACCCCTACGAGCAGTGGTCAGATCAAGAGATCTGGAAGGTGGCCGAT
CFTR-C043  AGGAAGAACCTCGACCCCTACGAGCAGTGGTCAGATCAAGAGATCTGGAAGGTGGCCGAT
CFTR-C003  AGGAAGAATCTGGACCCCTATGAGCAGTGGTCGGATCAGGAGATTTGGAAGGTGGCCGAC
CFTR-C028  AGGAAGAATCTGGACCCCTATGAGCAGTGGTCGGATCAGGAGATTTGGAAGGTGGCCGAC
CFTR-C016  CGTAAGAACCTCGACCCCTACGAGCAGTGGAGCGACCAGGAAATCTGGAAGGTGGCCGAC
CFTR-C041  CGTAAGAACCTCGACCCCTACGAGCAGTGGAGCGACCAGGAAATCTGGAAGGTGGCCGAC
CFTR-C010  AGGAAGAACCTGGACCCGTACGAGCAATGGTCCGACCAGGAGATCTGGAAGGTTGCCGAC
CFTR-C035  AGGAAGAACCTGGACCCGTACGAGCAATGGTCCGACCAGGAGATCTGGAAGGTTGCCGAC
CFTR-C012  AGGAAAAATCTCGACCCGTATGAACAGTGGAGCGACCAAGAAATCTGGAAGGTGGCAGAC
CFTR-C037  AGGAAAAATCTCGACCCGTATGAACAGTGGAGCGACCAAGAAATCTGGAAGGTGGCAGAC
CFTR-C009  CGGAAGAACCTGGACCCCTACGAGCAGTGGTCCGACCAAGAGATTTGGAAGGTTGCCGAC
CFTR-C034  CGGAAGAACCTGGACCCCTACGAGCAGTGGTCCGACCAAGAGATTTGGAAGGTTGCCGAC
CFTR-C015  CGTAAGAACCTCGACCCCTACGAGCAGTGGAGCGACCAGGAGATCTGGAAGGTCGCGGAC
CFTR-C040  CGTAAGAACCTCGACCCCTACGAGCAGTGGAGCGACCAGGAGATCTGGAAGGTCGCGGAC
CFTR-C019  AGAAAGAACCTGGACCCCTACGAGCAATGGTCAGACCAGGAGATCTGGAAGGTGGCCGAT
CFTR-C044  AGAAAGAACCTGGACCCCTACGAGCAATGGTCAGACCAGGAGATCTGGAAGGTGGCCGAT
CFTR-C007  CGCAAAAACCTAGATCCCTACGAGCAGTGGAGCGACCAGGAGATGGAAGGTGGCCGAC
CFTR-C032  CGCAAAAACCTAGATCCCTACGAGCAGTGGAGCGACCAGGAGATGGAAGGTGGCCGAC
CFTR-C014  AGGAAGAACCTCGACCCCTACGAACAATGGTCCGATCAGGAAATCTGGAAGGTGGCCGAC
CFTR-C039  AGGAAGAACCTCGACCCCTACGAACAATGGTCCGATCAGGAAATCTGGAAGGTGGCCGAC
CFTR-C025  AGGAAGAACCTCGACCCCTACGAGCAGTGGTCGGACCAGGAGATCTGGAAGGTGGCCGAC
CFTR-C050  AGGAAGAACCTCGACCCCTACGAGCAGTGGTCGGACCAGGAGATCTGGAAGGTGGCCGAC
CFTR-C023  AGAAAGAATCTGGATCCCTACGAGCAGTGGAGCGACCAGGAGATCTGGAAGGTGGCCGAC
CFTR-C048  AGAAAGAATCTGGATCCCTACGAGCAGTGGAGCGACCAGGAGATCTGGAAGGTGGCCGAC
CFTR-C024  CGGAAGAATCTGGACCCCTACGAACAGTGGAGCGACCAGGAAATCTGGAAGGTGGCCGAC
CFTR-C049  CGGAAGAATCTGGACCCCTACGAACAGTGGAGCGACCAGGAAATCTGGAAGGTGGCCGAC
```

FIG. 10 (cont)

```
CFTR-WT    GAGGTTGGGCTCAGATCTGTGATAGAACAGTTTCCTGGGAAGCTTGACTTTGTCCTTGTG
CFTR-C001  GAGGTGGGCCTGAGAAGCGTGATAGAACAATTCCCCGGCAAGCTGGATTTCGTGCTCGTG
CFTR-C026  GAGGTGGGCCTGAGAAGCGTGATAGAACAATTCCCCGGCAAGCTGGATTTCGTGCTCGTG
CFTR-C004  GAGGTGGGGCTGCGGTCCGTGATCGAGCAGTTCCCCGGCAAGCTGGATTTCGTCCTGGTG
CFTR-C029  GAGGTGGGGCTGCGGTCCGTGATCGAGCAGTTCCCCGGCAAGCTGGATTTCGTCCTGGTG
CFTR-C021  GAGGTGGGGCTGCGTTCCGTGATCGAACAGTTTCCCGGCAAACTCGACTTCGTGCTGGTC
CFTR-C046  GAGGTGGGGCTGCGTTCCGTGATCGAACAGTTTCCCGGCAAACTCGACTTCGTGCTGGTC
CFTR-C008  GAGGTAGGCCTGCGGAGCGTCATCGAACAGTTCCCCGGCAAGCTGGACTTCGTCCTGGTC
CFTR-C033  GAGGTAGGCCTGCGGAGCGTCATCGAACAGTTCCCCGGCAAGCTGGACTTCGTCCTGGTC
CFTR-C022  GAGGTGGGCCTCAGGAGCGTGATCGAGCAATTCCCCGGCAAGCTGGACTTCGTGCTGGTG
CFTR-C047  GAGGTGGGCCTCAGGAGCGTGATCGAGCAATTCCCCGGCAAGCTGGACTTCGTGCTGGTG
CFTR-C017  GAGGTGGGCCTGAGGTCAGTGATCGAGCAGTTCCCCGGGAAGCTGGACTTCGTGCTGGTG
CFTR-C042  GAGGTGGGCCTGAGGTCAGTGATCGAGCAGTTCCCCGGGAAGCTGGACTTCGTGCTGGTG
CFTR-C020  GAAGTCGGCCTGAGGAGCGTGATCGAGCAGTTTCCCGGCAAACTCGACTTCGTGCTGGTG
CFTR-C045  GAAGTCGGCCTGAGGAGCGTGATCGAGCAGTTTCCCGGCAAACTCGACTTCGTGCTGGTG
CFTR-C013  GAGGTAGGCCTGAGAAGCGTTATCGAGCAGTTCCCCGGCAAGCTGGACTTCGTCCTGGTC
CFTR-C038  GAGGTAGGCCTGAGAAGCGTTATCGAGCAGTTCCCCGGCAAGCTGGACTTCGTCCTGGTC
CFTR-C002  GAGGTGGGGCTGAGGAGCGTAATCGAGCAGTTCCCCGGCAAACTAGACTTCGTGCTGGTG
CFTR-C027  GAGGTGGGGCTGAGGAGCGTAATCGAGCAGTTCCCCGGCAAACTAGACTTCGTGCTGGTG
CFTR-C011  GAGGTTGGCCTGAGGTCCGTGATCGAGCAATTCCCCGGCAAGTTAGACTTTGTGCTGGTG
CFTR-C036  GAGGTTGGCCTGAGGTCCGTGATCGAGCAATTCCCCGGCAAGTTAGACTTTGTGCTGGTG
CFTR-C005  GAGGTGGGCCTGCGGAGCGTCATAGAACAGTTCCCCGGCAAGCTGGACTTCGTGTTGGTC
CFTR-C030  GAGGTGGGCCTGCGGAGCGTCATAGAACAGTTCCCCGGCAAGCTGGACTTCGTGTTGGTC
CFTR-C006  GAGGTGGGCCTCAGGAGCGTGATCGAGCAGTTCCCCGGCAAGCTGGACTTCGTGCTGGTG
CFTR-C031  GAGGTGGGCCTCAGGAGCGTGATCGAGCAGTTCCCCGGCAAGCTGGACTTCGTGCTGGTG
CFTR-C018  GAGGTGGGCCTGAGGTCAGTGATCGAGCAGTTCCCCGGCAAGCTCGATTTTGTGCTGGTG
CFTR-C043  GAGGTGGGCCTGAGGTCAGTGATCGAGCAGTTCCCCGGCAAGCTCGATTTTGTGCTGGTG
CFTR-C003  GAGGTGGGCCTGAGGAGCGTGATCGAGCAGTTCCCCGGAAAACTGGATTTCGTGCTGGTG
CFTR-C028  GAGGTGGGCCTGAGGAGCGTGATCGAGCAGTTCCCCGGAAAACTGGATTTCGTGCTGGTG
CFTR-C016  GAGGTGGGCCTGAGGTCCGTGATCGAGCAGTTCCCCGGCAAGCTGGACTTCGTGCTCGTG
CFTR-C041  GAGGTGGGCCTGAGGTCCGTGATCGAGCAGTTCCCCGGCAAGCTGGACTTCGTGCTCGTG
CFTR-C010  GAGGTCGGCCTGAGGTCCGTGATCGAGCAGTTCCCCGGCAAGCTCGACTTTGTGCTGGTG
CFTR-C035  GAGGTCGGCCTGAGGTCCGTGATCGAGCAGTTCCCCGGCAAGCTCGACTTTGTGCTGGTG
CFTR-C012  GAGGTGGGCCTGAGATCCGTGATCGAGCAATTCCCCGGCAAGCTGGATTTCGTGCTGGTC
CFTR-C037  GAGGTGGGCCTGAGATCCGTGATCGAGCAATTCCCCGGCAAGCTGGATTTCGTGCTGGTC
CFTR-C009  GAGGTGGGCCTGAGGAGCGTGATCGAGCAGTTCCCCGGCAAGCTCGACTTCGTCCTGGTG
CFTR-C034  GAGGTGGGCCTGAGGAGCGTGATCGAGCAGTTCCCCGGCAAGCTCGACTTCGTCCTGGTG
CFTR-C015  GAAGTGGGGCTGAGGAGCGTCATCGAGCAGTTCCCCGGCAAGCTGGACTTCGTGCTGGTG
CFTR-C040  GAAGTGGGGCTGAGGAGCGTCATCGAGCAGTTCCCCGGCAAGCTGGACTTCGTGCTGGTG
CFTR-C019  GAGGTGGGCCTGCGGAGCGTGATCGAGCAGTTCCCCGGCAAGCTGGACTTCGTGCTGGTG
CFTR-C044  GAGGTGGGCCTGCGGAGCGTGATCGAGCAGTTCCCCGGCAAGCTGGACTTCGTGCTGGTG
CFTR-C007  GAGGTGGGGCTGCGTAGCGTGATCGAGCAGTTCCCCGGCAAACTGGACTTCGTGCTGGTG
CFTR-C032  GAGGTGGGGCTGCGTAGCGTGATCGAGCAGTTCCCCGGCAAACTGGACTTCGTGCTGGTG
CFTR-C014  GAGGTGGGCCTGCGGAGCGTGATCGAGCAATTCCCTGGTAAGCTGGACTTTGTCCTGGTG
CFTR-C039  GAGGTGGGCCTGCGGAGCGTGATCGAGCAATTCCCTGGTAAGCTGGACTTTGTCCTGGTG
CFTR-C025  GAGGTCGGCCTGCGCTCCGTCATCGAGCAGTTTCCCGAAAACTGGACTTTGTCCTGGTG
CFTR-C050  GAGGTCGGCCTGCGCTCCGTCATCGAGCAGTTTCCCGAAAACTGGACTTTGTCCTGGTG
CFTR-C023  GAAGTGGGCCTAAGGAGCGTGATAGAACAGTTCCCCGGCAAGCTGGATTTTGTGCTGGTC
CFTR-C048  GAAGTGGGCCTAAGGAGCGTGATAGAACAGTTCCCCGGCAAGCTGGATTTTGTGCTGGTC
CFTR-C024  GAGGTGGGCCTTAGGAGCGTCATCGAGCAGTTCCCCGGGAAGCTGGACTTCGTACTGGTG
CFTR-C049  GAGGTGGGCCTTAGGAGCGTCATCGAGCAGTTCCCCGGGAAGCTGGACTTCGTACTGGTG
           **,** ** **    *    ** ** **,**,**,** ** **,,* **,**,** ,* **
```

FIG. 10 (cont)

```
CFTR-WT   GATGGGGGCTGTGTCCTAAGCCATGGCCACAAGCAGTTGATGTGCTTGGCTAGATCTGTT
CFTR-C001 GATGGGGGCTGTGTCCTCTCTCACGGCCACAAGCAGCTGATGTGCCTGGCCCGGAGCGTG
CFTR-C026 GATGGGGGCTGTGTCCTCTCTCACGGCCACAAGCAGCTGATGTGCCTGGCCCGGAGCGTG
CFTR-C004 GATGGGGGCTGCGTGCTTAGCCACGGCCACAAGCAGCTGATGTGCCTGGCGAGGTCAGTG
CFTR-C029 GATGGGGGCTGCGTGCTTAGCCACGGCCACAAGCAGCTGATGTGCCTGGCGAGGTCAGTG
CFTR-C021 GACGGCGGCTGTGTGCTCAGCCACGGCCATAAGCAGCTGATGTGCCTGGCCAGGTCCGTC
CFTR-C046 GACGGCGGCTGTGTGCTCAGCCACGGCCATAAGCAGCTGATGTGCCTGGCCAGGTCCGTC
CFTR-C008 GACGGCGGATGCGTGCTGAGCCACGGGCACAAGCAGCTGATGTGCCTGGCCAGGAGCGTG
CFTR-C033 GACGGCGGATGCGTGCTGAGCCACGGGCACAAGCAGCTGATGTGCCTGGCCAGGAGCGTG
CFTR-C022 GACGGGGGCTGCGTGCTGAGTCACGGGCACAAGCAGCTGATGTGCCTGGCCCGGTCCGTG
CFTR-C047 GACGGGGGCTGCGTGCTGAGTCACGGGCACAAGCAGCTGATGTGCCTGGCCCGGTCCGTG
CFTR-C017 GACGGCGGGTGCGTGCTCAGCCATGGCCACAAGCAGCTGATGTGCCTGGCCCGCAGCGTG
CFTR-C042 GACGGCGGGTGCGTGCTCAGCCATGGCCACAAGCAGCTGATGTGCCTGGCCCGCAGCGTG
CFTR-C020 GACGGCGGGTGCGTGCTGAGCCACGGCCACAAACAACTCATGTGCCTGGCCCGGAGCGTG
CFTR-C045 GACGGCGGGTGCGTGCTGAGCCACGGCCACAAACAACTCATGTGCCTGGCCCGGAGCGTG
CFTR-C013 GACGGCGGCTGTGTGCTCAGCCACGGCCATAAACAGCTGATGTGCCTGGCCCGAAGCGTG
CFTR-C038 GACGGCGGCTGTGTGCTCAGCCACGGCCATAAACAGCTGATGTGCCTGGCCCGAAGCGTG
CFTR-C002 GACGGAGGGTGCGTGCTCAGCCACGGACACAAACAGCTGATGTGCCTGGCCAGGAGCGTC
CFTR-C027 GACGGAGGGTGCGTGCTCAGCCACGGACACAAACAGCTGATGTGCCTGGCCAGGAGCGTC
CFTR-C011 GACGGGGGCTGCGTGCTCAGCCACGGGCACAAGCAGCTGATGTGCCTGGCCAGGAGCGTG
CFTR-C036 GACGGGGGCTGCGTGCTCAGCCACGGGCACAAGCAGCTGATGTGCCTGGCCAGGAGCGTG
CFTR-C005 GACGGCGGGTGTGTCCTGAGCCACGGCCACAAGCAGCTCATGTGCCTGGCCCGCAGCGTC
CFTR-C030 GACGGCGGGTGTGTCCTGAGCCACGGCCACAAGCAGCTCATGTGCCTGGCCCGCAGCGTC
CFTR-C006 GACGGCGGCTGCGTGCTGAGCCACGGCCATAAGCAGCTGATGTGCCTGGCCAGGAGCGTG
CFTR-C031 GACGGCGGCTGCGTGCTGAGCCACGGCCATAAGCAGCTGATGTGCCTGGCCAGGAGCGTG
CFTR-C018 GATGGTGGGTGCGTGCTGTCCCACGGCCACAAGCAACTGATGTGCCTGGCAAGGAGCGTC
CFTR-C043 GATGGTGGGTGCGTGCTGTCCCACGGCCACAAGCAACTGATGTGCCTGGCAAGGAGCGTC
CFTR-C003 GATGGCGGCTGCGTCCTGTCCCACGGCCACAAACAGCTGATGTGTCTGGCCCGCAGCGTC
CFTR-C028 GATGGCGGCTGCGTCCTGTCCCACGGCCACAAACAGCTGATGTGTCTGGCCCGCAGCGTC
CFTR-C016 GACGGCGGGTGCGTGCTGTCCCACGGCCACAAGCAGCTGATGTGTCTGGCCAGGAGCGTG
CFTR-C041 GACGGCGGGTGCGTGCTGTCCCACGGCCACAAGCAGCTGATGTGTCTGGCCAGGAGCGTG
CFTR-C010 GATGGGGGCTGCGTGCTCAGCCACGGCCACAAGCAGCTGATGTGCCTCGCCAGGAGCGTG
CFTR-C035 GATGGGGGCTGCGTGCTCAGCCACGGCCACAAGCAGCTGATGTGCCTCGCCAGGAGCGTG
CFTR-C012 GACGGCGGCTGCGTGCTCAGCCACGGGCACAAGCAGCTGATGTGCCTGGCCAGGTCCGTC
CFTR-C037 GACGGCGGCTGCGTGCTCAGCCACGGGCACAAGCAGCTGATGTGCCTGGCCAGGTCCGTC
CFTR-C009 GACGGGGGCTGCGTGCTGAGCCACGGGCACAAGCAGCTGATGTGCCTGGCCAGGAGCGTC
CFTR-C034 GACGGGGGCTGCGTGCTGAGCCACGGGCACAAGCAGCTGATGTGCCTGGCCAGGAGCGTC
CFTR-C015 GACGGGGGCTGCGTGCTGAGCCACGGCCATAAACAGCTGATGTGCCTGGCACGGAGCGTG
CFTR-C040 GACGGGGGCTGCGTGCTGAGCCACGGCCATAAACAGCTGATGTGCCTGGCACGGAGCGTG
CFTR-C019 GACGGCGGCTGCGTCCTGAGCCACGGCCACAAGCAACTGATGTGCCTCGCCAGGAGCGTC
CFTR-C044 GACGGCGGCTGCGTCCTGAGCCACGGCCACAAGCAACTGATGTGCCTCGCCAGGAGCGTC
CFTR-C007 GACGGGGGCTGCGTGCTCAGCCACGGCCACAAGCAGCTGATGTGCCTGGCCCGGTCCGTG
CFTR-C032 GACGGGGGCTGCGTGCTCAGCCACGGCCACAAGCAGCTGATGTGCCTGGCCCGGTCCGTG
CFTR-C014 GACGGCGGCTGCGTGCTCAGCCACGGCCACAAGCAGCTGATGTGCCTGGCCCGGTCCGTG
CFTR-C039 GACGGCGGCTGCGTGCTCAGCCACGGCCACAAGCAGCTGATGTGCCTGGCCCGGTCCGTG
CFTR-C025 GACGGAGGTTGCGTGCTGTCTCACGGTCACAAGCAGCTGATGTGTCTGGCCCGCTCCGTG
CFTR-C050 GACGGAGGTTGCGTGCTGTCTCACGGTCACAAGCAGCTGATGTGTCTGGCCCGCTCCGTG
CFTR-C023 GATGGCGGCTGCGTGCTGAGCCACGGGCACAAGCAGCTGATGTGCCTGGCCCGGAGCGTG
CFTR-C048 GATGGCGGCTGCGTGCTGAGCCACGGGCACAAGCAGCTGATGTGCCTGGCCCGGAGCGTG
CFTR-C024 GACGGTGGCTGCGTGCTGAGCCACGGGCACAAGCAACTGATGTGTCTGGCCCGGTCGGTG
CFTR-C049 GACGGTGGCTGCGTGCTGAGCCACGGGCACAAGCAACTGATGTGTCTGGCCCGGTCGGTG
          **.** ** **.** **  .**.** **.**.**..* *****..* **  *    **
```

FIG. 10 (cont)

```
CFTR-WT    CTCAGTAAGGCGAAGATCTTGCTGCTTGATGAACCCAGTGCTCATTTGGATCCAGTAACA
CFTR-C001  CTGTCCAAGGCAAAGATCCTGCTGCTGGACGAGCCCAGCGCACACCTCGACCCCGTGACT
CFTR-C026  CTGTCCAAGGCAAAGATCCTGCTGCTGGACGAGCCCAGCGCACACCTCGACCCCGTGACT
CFTR-C004  CTGAGCAAGGCCAAAATCCTGCTCCTGGACGAGCCTAGCGCGCACCTGGACCCCGTGACC
CFTR-C029  CTGAGCAAGGCCAAAATCCTGCTCCTGGACGAGCCTAGCGCGCACCTGGACCCCGTGACC
CFTR-C021  CTCAGCAAGGCCAAGATCCTGCTCCTGGACGAGCCCTCCGCCCACCTGGACCCCGTGACC
CFTR-C046  CTCAGCAAGGCCAAGATCCTGCTCCTGGACGAGCCCTCCGCCCACCTGGACCCCGTGACC
CFTR-C008  CTGAGCAAAGCCAAAATCCTGCTGCTGGATGAGCCGTCCGCCCACCTGGACCCCGTGACC
CFTR-C033  CTGAGCAAAGCCAAAATCCTGCTGCTGGATGAGCCGTCCGCCCACCTGGACCCCGTGACC
CFTR-C022  CTGAGCAAGGCCAAGATCCTCCTGCTGGACGAGCCCTCCGCGCACCTGGATCCCGTGACC
CFTR-C047  CTGAGCAAGGCCAAGATCCTCCTGCTGGACGAGCCCTCCGCGCACCTGGATCCCGTGACC
CFTR-C017  CTGAGCAAGGCCAAGATCCTCCTGCTGGATGAGCCCAGCGCCCACCTGGACCCCGTGACC
CFTR-C042  CTGAGCAAGGCCAAGATCCTCCTGCTGGATGAGCCCAGCGCCCACCTGGATCCCGTGACC
CFTR-C020  CTGTCCAAAGCCAAGATCCTGCTGCTGGACGAGCCCAGCGCCCACCTGGACCCCGTCACC
CFTR-C045  CTGTCCAAAGCCAAGATCCTGCTGCTGGACGAGCCCAGCGCCCACCTGGACCCCGTCACC
CFTR-C013  CTGAGCAAGGCGAAAATCCTCCTGCTGGACGAGCCCTCGGCCCACCTGGACCCCGTGACT
CFTR-C038  CTGAGCAAGGCGAAAATCCTCCTGCTGGACGAGCCCTCGGCCCACCTGGACCCCGTGACT
CFTR-C002  CTCAGCAAGGCCAAGATACTGCTGCTGGACGAGCCCTCCGCCCACCTGGACCCCGTTACG
CFTR-C027  CTCAGCAAGGCCAAGATACTGCTGCTGGACGAGCCCTCCGCCCACCTGGACCCCGTTACG
CFTR-C011  TTGAGCAAGGCCAAGATCCTCCTTCTGGACGAGCCCTCCGCCCACCTGGACCCAGTCACC
CFTR-C036  TTGAGCAAGGCCAAGATCCTCCTTCTGGACGAGCCCTCCGCCCACCTGGACCCAGTCACC
CFTR-C005  CTGTCCAAAGCCAAAATACTGCTCCTGGACGAGCCAAGCGCCCACCTGGACCCCGTGACC
CFTR-C030  CTGTCCAAAGCCAAAATACTGCTCCTGGACGAGCCAAGCGCCCACCTGGACCCCGTGACC
CFTR-C006  CTGTCCAAAGCCAAGATCCTCCTCCTGGATGAGCCGAGCGCCCATCTGGACCCGGTGACC
CFTR-C031  CTGTCCAAAGCCAAGATCCTCCTCCTGGATGAGCCGAGCGCCCATCTGGACCCGGTGACC
CFTR-C018  CTGTCGAAGGCCAAGATCCTGCTGCTGGACGAACCCTCCGCCCACCTGGACCCCGTGACT
CFTR-C043  CTGTCGAAGGCCAAGATCCTGCTGCTGGACGAACCCTCCGCCCACCTGGACCCCGTGACT
CFTR-C003  CTGTCCAAGGCCAAGATCCTGCTGCTGGACGAGCCGAGCGCTCATCTCGATCCTGTCACC
CFTR-C028  CTGTCCAAGGCCAAGATCCTGCTGCTGGACGAGCCGAGCGCTCATCTCGATCCTGTCACC
CFTR-C016  CTGAGCAAGGCCAAGATCCTGCTCCTGGACGAGCCCAGCGCTCACCTGGACCCCGTGACG
CFTR-C041  CTGAGCAAGGCCAAGATCCTGCTCCTGGACGAGCCCAGCGCTCACCTGGACCCCGTGACG
CFTR-C010  CTGTCCAAAGCCAAGATCCTGCTGCTGGACGAGCCCAGCGCCCATCTGGATCCCGTTACC
CFTR-C035  CTGTCCAAAGCCAAGATCCTGCTGCTGGACGAGCCCAGCGCCCATCTGGATCCCGTTACC
CFTR-C012  CTCAGCAAGGCCAAGATCCTGCTGCTGGACGAGCCCTCCGCCCATCTGGACCCCGTGACC
CFTR-C037  CTCAGCAAGGCCAAGATCCTGCTGCTGGACGAGCCCTCCGCCCATCTGGACCCCGTGACC
CFTR-C009  CTGAGCAAAGCCAAGATCCTCCTGCTTGACGAGCCCAGCGCCCACCTGGACCCGGTGACG
CFTR-C034  CTGAGCAAAGCCAAGATCCTCCTGCTTGACGAGCCCAGCGCCCACCTGGACCCGGTGACG
CFTR-C015  CTGTCCAAGGCGAAGATACTGCTCCTGGACGAGCCCAGCGCGCACCTGGATCCAGTCACC
CFTR-C040  CTGTCCAAGGCGAAGATACTGCTCCTGGACGAGCCCAGCGCGCACCTGGATCCAGTCACC
CFTR-C019  CTGTCAAAGGCTAAGATCCTGCTCCTCGACGAGCCCAGCGCCCACCTTGACCCCGTGACC
CFTR-C044  CTGTCAAAGGCTAAGATCCTGCTCCTCGACGAGCCCAGCGCCCACCTTGACCCCGTGACC
CFTR-C007  CTGAGCAAGGCCAAGATCCTGCTGCTGGACGAGCCCAGCGCCCACCTCGATCCCGTGACC
CFTR-C032  CTGAGCAAGGCCAAGATCCTGCTGCTGGACGAGCCCAGCGCCCACCTCGATCCCGTGACC
CFTR-C014  CTGAGCAAAGCGAAAATCCTGCTGCTGGACGAGCCCTCCGCCCACCTGGACCCGGTGACC
CFTR-C039  CTGAGCAAAGCGAAAATCCTGCTGCTGGACGAGCCCTCCGCCCACCTGGACCCGGTGACC
CFTR-C025  CTGAGCAAGGCCAAGATCCTGCTTCTGGACGAGCCCAGCGCCCACCTGGACCCCGTGACC
CFTR-C050  CTGAGCAAGGCCAAGATCCTGCTTCTGGACGAGCCCAGCGCCCACCTGGACCCCGTGACC
CFTR-C023  CTGAGCAAGGCCAAGATCCTGCTGCTGGACGAGCCCTCCGCCCACCTGGACCCGGTGACC
CFTR-C048  CTGAGCAAGGCCAAGATCCTGCTGCTGGACGAGCCCTCCGCCCACCTGGACCCGGTGACC
CFTR-C024  CTGTCCAAGGCGAAAATCCTGCTCCTGGACGAGCCCAGCGCCCATCTGGATCCCGTGACC
CFTR-C049  CTGTCCAAGGCGAAAATCCTGCTCCTGGACGAGCCCAGCGCCCATCTGGATCCCGTGACC
           ,*   **,** **,** ,* ** ** **,**,**    ** **,,* **,** ** **
```

FIG. 10 (cont)

| | |
|---|---|
| CFTR-WT | TACCAAATAATTAGAAGAACTCTAAAACAAGCATTTGCTGATTGCACAGTAATTCTCTGT |
| CFTR-C001 | TACCAGATCATAAGGCGTACGCTGAAGCAGGCCTTCGCCGACTGCACCGTGATCCTCTGC |
| CFTR-C026 | TACCAGATCATAAGGCGTACGCTGAAGCAGGCCTTCGCCGACTGCACCGTGATCCTCTGC |
| CFTR-C004 | TACCAAATCATCAGGAGGACCCTGAAACAAGCCTTCGCCGACTGCACCGTGATCCTGTGC |
| CFTR-C029 | TACCAAATCATCAGGAGGACCCTGAAACAAGCCTTCGCCGACTGCACCGTGATCCTGTGC |
| CFTR-C021 | TACCAGATCATCAGGAGGACCCTGAAGCAGGCCTTCGCCGACTGCACTGTGATCCTCTGC |
| CFTR-C046 | TACCAGATCATCAGGAGGACCCTGAAGCAGGCCTTCGCCGACTGCACTGTGATCCTCTGC |
| CFTR-C008 | TATCAGATCATCAGGAGGACACTGAAGCAGGCCTTCGCCGACTGCACCGTGATCCTCTGC |
| CFTR-C033 | TATCAGATCATCAGGAGGACACTGAAGCAGGCCTTCGCCGACTGCACCGTGATCCTCTGC |
| CFTR-C022 | TACCAGATTATCCGGAGGACCCTGAAGCAGGCATTTGCCGACTGCACCGTGATCCTGTGC |
| CFTR-C047 | TACCAGATTATCCGGAGGACCCTGAAGCAGGCATTTGCCGACTGCACCGTGATCCTGTGC |
| CFTR-C017 | TACCAAATCATCAGGAGGACCCTAAAGCAGGCCTTCGCCGACTGCACCGTTATCCTGTGC |
| CFTR-C042 | TACCAAATCATCAGGAGGACCCTAAAGCAGGCCTTCGCCGACTGCACCGTTATCCTGTGC |
| CFTR-C020 | TACCAGATCATCAGGAGGACTCTGAAGCAGGCGTTCGCCGACTGCACCGTGATCCTGTGT |
| CFTR-C045 | TACCAGATCATCAGGAGGACTCTGAAGCAGGCGTTCGCCGACTGCACCGTGATCCTGTGT |
| CFTR-C013 | TACCAGATCATTCGACGTACCCTGAAGCAGGCCTTTGCCGATTGTACCGTCATACTGTGC |
| CFTR-C038 | TACCAGATCATTCGACGTACCCTGAAGCAGGCCTTTGCCGATTGTACCGTCATACTGTGC |
| CFTR-C002 | TACCAGATCATCAGGAGGACCCTGAAGCAGGCCTTCGCCGACTGCACCGTGATCCTCTGC |
| CFTR-C027 | TACCAGATCATCAGGAGGACCCTGAAGCAGGCCTTCGCCGACTGCACCGTGATCCTCTGC |
| CFTR-C011 | TACCAGATCATCAGGCGAACCCTGAAGCAGGCCTTCGCCGACTGCACCGTGATCCTGTGT |
| CFTR-C036 | TACCAGATCATCAGGCGAACCCTGAAGCAGGCCTTCGCCGACTGCACCGTGATCCTGTGT |
| CFTR-C005 | TACCAGATCATCCGGAGGACCCTGAAGCAGGCCTTCGCCGACTGCACCGTCATCCTGTGC |
| CFTR-C030 | TACCAGATCATCCGGAGGACCCTGAAGCAGGCCTTCGCCGACTGCACCGTCATCCTGTGC |
| CFTR-C006 | TACCAGATCATCCGAAGGACTCTGAAGCAGGCCTTTGCGGACTGCACCGTGATCCTGTGC |
| CFTR-C031 | TACCAGATCATCCGAAGGACTCTGAAGCAGGCCTTTGCGGACTGCACCGTGATCCTGTGC |
| CFTR-C018 | TATCAGATCATCCGAAGAACCCTGAAGCAGGCCTTCGCCGATTGTACCGTGATCCTCTGC |
| CFTR-C043 | TATCAGATCATCCGAAGAACCCTGAAGCAGGCCTTCGCCGATTGTACCGTGATCCTCTGC |
| CFTR-C003 | TACCAGATCATCCGGAGGACCCTGAAACAGGCATTCGCCGACTGTACGGTCATCCTGTGT |
| CFTR-C028 | TACCAGATCATCCGGAGGACCCTGAAACAGGCATTCGCCGACTGTACGGTCATCCTGTGT |
| CFTR-C016 | TACCAGATCATCCGACGAACCCTCAAGCAGGCCTTCGCCGACTGCACAGTTATCCTCTGC |
| CFTR-C041 | TACCAGATCATCCGACGAACCCTCAAGCAGGCCTTCGCCGACTGCACAGTTATCCTCTGC |
| CFTR-C010 | TATCAGATCATCCGGCGGACGCTGAAGCAGGCCTTCGCCGACTGTACAGTGATCCTGTGC |
| CFTR-C035 | TATCAGATCATCCGGCGGACGCTGAAGCAGGCCTTCGCCGACTGTACAGTGATCCTGTGC |
| CFTR-C012 | TACCAGATCATCAGGCGGACCCTCAAGCAAGCCTTCGCCGACTGCACCGTTATACTGTGC |
| CFTR-C037 | TACCAGATCATCAGGCGGACCCTCAAGCAAGCCTTCGCCGACTGCACCGTTATACTGTGC |
| CFTR-C009 | TACCAGATCATCCGCAGGACGCTGAAACAGGCATTCGCCGACTGCACCGTGATCCTCTGC |
| CFTR-C034 | TACCAGATCATCCGCAGGACGCTGAAACAGGCATTCGCCGACTGCACCGTGATCCTCTGC |
| CFTR-C015 | TACCAGATCATCAGGAGGACCCTGAAGCAGGCCTTCGCCGACTGTACCGTGATCCTGTGC |
| CFTR-C040 | TACCAGATCATCAGGAGGACCCTGAAGCAGGCCTTCGCCGACTGTACCGTGATCCTGTGC |
| CFTR-C019 | TACCAGATCATCCGGAGGACGCTGAAGCAAGCCTTCGCCGATTGCACCGTCATCCTGTGC |
| CFTR-C044 | TACCAGATCATCCGGAGGACGCTGAAGCAAGCCTTCGCCGATTGCACCGTCATCCTGTGC |
| CFTR-C007 | TACCAGATCATCAGGAGAACCCTGAAGCAGGCCTTCGCCGACTGCACCGTGATCCTGTGC |
| CFTR-C032 | TACCAGATCATCAGGAGAACCCTGAAGCAGGCCTTCGCCGACTGCACCGTGATCCTGTGC |
| CFTR-C014 | TACCAAATCATCAGGCGGACGCTGAAGCAAGCCTTCGCCGACTGCACCGTCATACTGTGC |
| CFTR-C039 | TACCAAATCATCAGGCGGACGCTGAAGCAAGCCTTCGCCGACTGCACCGTCATACTGTGC |
| CFTR-C025 | TACCAAATCATCCGCCGCACCCTGAAGCAGGCCTTCGCCGACTGTACCGTGATACTGTGC |
| CFTR-C050 | TACCAAATCATCCGCCGCACCCTGAAGCAGGCCTTCGCCGACTGTACCGTGATACTGTGC |
| CFTR-C023 | TACCAGATCATCAGGAGGACCCTCAAGCAGGCCTTCGCCGACTGCACCGTCATCCTCTGC |
| CFTR-C048 | TACCAGATCATCAGGAGGACCCTCAAGCAGGCCTTCGCCGACTGCACCGTCATCCTCTGC |
| CFTR-C024 | TACCAGATCATACGCCGGACCCTGAAGCAGGCCTTCGCCGACTGCACCGTAATACTGTGC |
| CFTR-C049 | TACCAGATCATACGCCGGACCCTGAAGCAGGCCTTCGCCGACTGCACCGTAATACTGTGC |

FIG. 10 (cont)

```
CFTR-WT    GAACACAGGATAGAAGCAATGCTGGAATGCCAACAATTTTTGGTCATAGAAGAGAACAAA
CFTR-C001  GAGCATAGGATCGAGGCCATGCTGGAGTGCCAGCAGTTCCTCGTGATAGAGGAGAACAAA
CFTR-C026  GAGCATAGGATCGAGGCCATGCTGGAGTGCCAGCAGTTCCTCGTGATAGAGGAGAACAAA
CFTR-C004  GAGCACCGCATCGAGGCCATGCTGGAATGCCAGCAGTTCCTGGTGATCGAGGAGAATAAG
CFTR-C029  GAGCACCGCATCGAGGCCATGCTGGAATGCCAGCAGTTCCTGGTGATCGAGGAGAATAAG
CFTR-C021  GAGCACAGAATCGAGGCCATGCTCGAATGCCAGCAGTTCCTGGTGATCGAAGAGAACAAG
CFTR-C046  GAGCACAGAATCGAGGCCATGCTCGAATGCCAGCAGTTCCTGGTGATCGAAGAGAACAAG
CFTR-C008  GAGCACCGCATCGAAGCCATGCTGGAGTGTCAGCAGTTCCTGGTGATCGAGGAAAACAAG
CFTR-C033  GAGCACCGCATCGAAGCCATGCTGGAGTGTCAGCAGTTCCTGGTGATCGAGGAAAACAAG
CFTR-C022  GAGCACCGTATCGAGGCGATGCTGGAATGCCAGCAGTTTCTAGTGATCGAAGAGAACAAA
CFTR-C047  GAGCACCGTATCGAGGCGATGCTGGAATGCCAGCAGTTTCTAGTGATCGAAGAGAACAAA
CFTR-C017  GAGCACCGGATCGAAGCCATGCTGGAGTGCCAGCAGTTCCTGGTGATCGAGGAGAATAAG
CFTR-C042  GAGCACCGGATCGAAGCCATGCTGGAGTGCCAGCAGTTCCTGGTGATCGAGGAGAATAAG
CFTR-C020  GAGCACAGGATCGAGGCCATGCTGGAGTGCCAGCAGTTCCTAGTGATCGAGGAGAACAAG
CFTR-C045  GAGCACAGGATCGAGGCCATGCTGGAGTGCCAGCAGTTCCTAGTGATCGAGGAGAACAAG
CFTR-C013  GAGCACAGGATCGAGGCCATGCTGGAGTGCCAACAGTTCCTGGTGATCGAGGAAAACAAG
CFTR-C038  GAGCACAGGATCGAGGCCATGCTGGAGTGCCAACAGTTCCTGGTGATCGAGGAAAACAAG
CFTR-C002  GAGCACAGGATCGAGGCCATGCTGGAGTGTCAGCAGTTCCTTGTCATCGAGGAGAATAAA
CFTR-C027  GAGCACAGGATCGAGGCCATGCTGGAGTGTCAGCAGTTCCTTGTCATCGAGGAGAATAAA
CFTR-C011  GAGCACCGGATCGAGGCCATGCTGGAGTGCCAGCAGTTCCTGGTGATCGAGGAGAACAAG
CFTR-C036  GAGCACCGGATCGAGGCCATGCTGGAGTGCCAGCAGTTCCTGGTGATCGAGGAGAACAAG
CFTR-C005  GAACACAGGATCGAAGCCATGCTGGAGTGCCAGCAGTTCCTGGTGATCGAAGAGAACAAG
CFTR-C030  GAACACAGGATCGAAGCCATGCTGGAGTGCCAGCAGTTCCTGGTGATCGAAGAGAACAAG
CFTR-C006  GAGCACAGGATCGAGGCGATGCTGGAGTGCCAGCAGTTCCTGGTGATCGAAGAGAACAAG
CFTR-C031  GAGCACAGGATCGAGGCGATGCTGGAGTGCCAGCAGTTCCTGGTGATCGAAGAGAACAAG
CFTR-C018  GAGCACCGGATCGAAGCCATGCTGGAGTGCCAGCAGTTCCTGGTGATCGAGGAAAACAAG
CFTR-C043  GAGCACCGGATCGAAGCCATGCTGGAGTGCCAGCAGTTCCTGGTGATCGAGGAAAACAAG
CFTR-C003  GAACACCGAATAGAAGCCATGCTGGAATGCCAACAGTTCCTGGTGATCGAGGAGAATAAG
CFTR-C028  GAACACCGAATAGAAGCCATGCTGGAATGCCAACAGTTCCTGGTGATCGAGGAGAATAAG
CFTR-C016  GAACACAGGATCGAAGCCATGCTCGAGTGCCAGCAGTTCCTGGTCATAGAGGAGAACAAG
CFTR-C041  GAACACAGGATCGAAGCCATGCTCGAGTGCCAGCAGTTCCTGGTCATAGAGGAGAACAAG
CFTR-C010  GAGCACAGAATCGAGGCCATGCTGGAGTGCCAGCAGTTCCTGGTGATTGAAGAGAACAAG
CFTR-C035  GAGCACAGAATCGAGGCCATGCTGGAGTGCCAGCAGTTCCTGGTGATTGAAGAGAACAAG
CFTR-C012  GAGCACAGGATCGAGGCCATGCTGGAGTGCCAACAGTTCCTGGTCATCGAAGAGAATAAG
CFTR-C037  GAGCACAGGATCGAGGCCATGCTGGAGTGCCAACAGTTCCTGGTCATCGAAGAGAATAAG
CFTR-C009  GAGCATAGGATCGAGGCCATGCTGGAGTGCCAGCAGTTCCTCGTCATCGAGGAGAATAAG
CFTR-C034  GAGCATAGGATCGAGGCCATGCTGGAGTGCCAGCAGTTCCTCGTCATCGAGGAGAATAAG
CFTR-C015  GAACACAGGATCGAGGCCATGCTCGAATGCCAGCAGTTCCTGGTGATCGAGGAGAACAAG
CFTR-C040  GAACACAGGATCGAGGCCATGCTCGAATGCCAGCAGTTCCTGGTGATCGAGGAGAACAAG
CFTR-C019  GAGCACAGGATCGAGGCCATGCTGGAATGCCAACAATTTCTGGTGATCGAGGAGAACAAG
CFTR-C044  GAGCACAGGATCGAGGCCATGCTGGAATGCCAACAATTTCTGGTGATCGAGGAGAACAAG
CFTR-C007  GAGCACAGGATCGAGGCCATGCTGGAATGCCAACAGTTCCTGGTCATCGAGGAGAACAAG
CFTR-C032  GAGCACAGGATCGAGGCCATGCTGGAATGCCAACAGTTCCTGGTCATCGAGGAGAACAAG
CFTR-C014  GAACACAGGATCGAGGCCATGTTAGAGTGCCAGCAGTTCCTGGTGATTGAGGAGAATAAG
CFTR-C039  GAACACAGGATCGAGGCCATGTTAGAGTGCCAGCAGTTCCTGGTGATTGAGGAGAATAAG
CFTR-C025  GAGCACCGCATCGAGGCCATGCTGGAGTGTCAGCAGTTCCTGGTGATCGAGGAGAACAAG
CFTR-C050  GAGCACCGCATCGAGGCCATGCTGGAGTGTCAGCAGTTCCTGGTGATCGAGGAGAACAAG
CFTR-C023  GAACACCGAATCGAGGCCATGCTCGAGTGCCAGCAGTTCCTGGTGATCGAGGAGAACAAG
CFTR-C048  GAACACCGAATCGAGGCCATGCTCGAGTGCCAGCAGTTCCTGGTGATCGAGGAGAACAAG
CFTR-C024  GAGCACCGGATCGAGGCCATGCTGGAGTGCCAGCAGTTCCTCGTGATCGAGGAGAACAAG
CFTR-C049  GAGCACCGGATCGAGGCCATGCTGGAGTGCCAGCAGTTCCTCGTGATCGAGGAGAACAAG
           **,**, * ** **,** ,** ***,*  **,**,**,**,**,,* ** ** **,**,**,**,
```

FIG. 10 (cont)

```
CFTR-WT    GTGCGGCAGTACGATTCCATCCAGAAACTGCTGAACGAGAGGAGCCTCTTCCGGCAAGCC
CFTR-C001  GTCAGGCAATACGACTCCATCCAGAAGCTGCTCAATGAGAGATCCCTGTTCCGGCAGGCC
CFTR-C026  GTCAGGCAATACGACTCCATCCAGAAGCTGCTCAATGAGAGATCCCTGTTCCGGCAGGCC
CFTR-C004  GTCCGGCAGTACGACTCAATCCAGAAGCTGCTCAACGAGCGTAGCCTGTTCAGGCAAGCC
CFTR-C029  GTCCGGCAGTACGACTCAATCCAGAAGCTGCTCAACGAGCGTAGCCTGTTCAGGCAAGCC
CFTR-C021  GTGAGGCAGTACGATTCCATCCAGAAGCTGCTGAACGAGAGGAGCCTGTTCAGGCAGGCC
CFTR-C046  GTGAGGCAGTACGATTCCATCCAGAAGCTGCTGAACGAGAGGAGCCTGTTCAGGCAGGCC
CFTR-C008  GTGCGGCAGTACGACAGCATCCAGAAGCTGCTGAACGAGAGGAGCCTCTTCCGCCAGGCC
CFTR-C033  GTGCGGCAGTACGACAGCATCCAGAAGCTGCTGAACGAGAGGAGCCTCTTCCGCCAGGCC
CFTR-C022  GTCAGGCAGTACGACTCCATCCAGAAGCTTCTGAACGAGAGGAGCCTGTTCCGGCAGGCC
CFTR-C047  GTCAGGCAGTACGACTCCATCCAGAAGCTTCTGAACGAGAGGAGCCTGTTCCGGCAGGCC
CFTR-C017  GTGCGGCAGTACGACAGCATCCAAAAGCTGCTGAACGAAAGGAGCCTGTTCAGGCAGGCC
CFTR-C042  GTGCGGCAGTACGACAGCATCCAAAAGCTGCTGAACGAAAGGAGCCTGTTCAGGCAGGCC
CFTR-C020  GTGAGGCAGTATGACAGCATCCAGAAGCTGCTAAACGAACGCTCCCTGTTTAGGCAGGCC
CFTR-C045  GTGAGGCAGTATGACAGCATCCAGAAGCTGCTAAACGAACGCTCCCTGTTTAGGCAGGCC
CFTR-C013  GTACGCCAGTACGACAGCATCCAGAAGCTCCTGAACGAGCGGTCCCTCTTTAGGCAGGCC
CFTR-C038  GTACGCCAGTACGACAGCATCCAGAAGCTCCTGAACGAGCGGTCCCTCTTTAGGCAGGCC
CFTR-C002  GTGAGGCAGTACGACTCCATCCAGAAGCTGCTGAACGAGCGGTCACTGTTTCGGCAAGCC
CFTR-C027  GTGAGGCAGTACGACTCCATCCAGAAGCTGCTGAACGAGCGGTCACTGTTTCGGCAAGCC
CFTR-C011  GTGCGGCAGTACGACAGCATCCAGAAGCTCCTGAACGAGAGGAGCCTGTTCCGCCAGGCC
CFTR-C036  GTGCGGCAGTACGACAGCATCCAGAAGCTCCTGAACGAGAGGAGCCTGTTCCGCCAGGCC
CFTR-C005  GTGCGGCAGTACGACAGCATCCAGAAGCTGCTGAATGAAAGATCCCTGTTCAGACAGGCC
CFTR-C030  GTGCGGCAGTACGACAGCATCCAGAAGCTGCTGAATGAAAGATCCCTGTTCAGACAGGCC
CFTR-C006  GTGAGGCAATACGACTCGATCCAGAAGCTGCTGAATGAGAGGTCCCTGTTTAGGCAGGCA
CFTR-C031  GTGAGGCAATACGACTCGATCCAGAAGCTGCTGAATGAGAGGTCCCTGTTTAGGCAGGCA
CFTR-C018  GTGCGTCAGTACGACAGCATCCAGAAGCTGCTGAATGAGCGCAGCCTGTTCCGACAGGCC
CFTR-C043  GTGCGTCAGTACGACAGCATCCAGAAGCTGCTGAATGAGCGCAGCCTGTTCCGACAGGCC
CFTR-C003  GTCAGGCAGTACGACTCCATCCAGAAGCTGCTGAATGAGCGATCCCTGTTCCGGCAGGCC
CFTR-C028  GTCAGGCAGTACGACTCCATCCAGAAGCTGCTGAATGAGCGATCCCTGTTCCGGCAGGCC
CFTR-C016  GTGCGGCAATATGACAGCATCCAGAAGCTGCTGAACGAGAGGAGCCTGTTCAGGCAGGCA
CFTR-C041  GTGCGGCAATATGACAGCATCCAGAAGCTGCTGAACGAGAGGAGCCTGTTCAGGCAGGCA
CFTR-C010  GTGCGGCAGTACGACAGCATACAGAAGCTGCTGAACGAAAGGTCCCTGTTTAGGCAAGCC
CFTR-C035  GTGCGGCAGTACGACAGCATACAGAAGCTGCTGAACGAAAGGTCCCTGTTTAGGCAAGCC
CFTR-C012  GTGAGGCAGTACGATAGCATCCAGAAGCTGCTGAACGAGCGGAGCCTGTTTCGTCAAGCC
CFTR-C037  GTGAGGCAGTACGATAGCATCCAGAAGCTGCTGAACGAGCGGAGCCTGTTTCGTCAAGCC
CFTR-C009  GTGCGGCAGTACGATTCCATCCAGAAGCTGCTGAACGAGAGGAGCCTGTTCCGGCAAGCC
CFTR-C034  GTGCGGCAGTACGATTCCATCCAGAAGCTGCTGAACGAGAGGAGCCTGTTCCGGCAAGCC
CFTR-C015  GTGCGGCAGTACGACAGCATCCAGAAACTGCTGAACGAGCGGAGCCTGTTCCGGCAGGCC
CFTR-C040  GTGCGGCAGTACGACAGCATCCAGAAACTGCTGAACGAGCGGAGCCTGTTCCGGCAGGCC
CFTR-C019  GTGAGGCAGTACGACTCCATCCAGAAGCTGCTGAACGAAAGGAGCCTGTTTAGGCAGGCC
CFTR-C044  GTGAGGCAGTACGACTCCATCCAGAAGCTGCTGAACGAAAGGAGCCTGTTTAGGCAGGCC
CFTR-C007  GTGCGGCAGTATGACAGCATCCAGAAGCTCTTGAACGAGAGGTCCCTCTTCAGGCAGGCA
CFTR-C032  GTGCGGCAGTATGACAGCATCCAGAAGCTCTTGAACGAGAGGTCCCTCTTCAGGCAGGCA
CFTR-C014  GTGCGCCAGTACGACAGCATCCAGAAACTGCTGAACGAGCGAAGCCTGTTCCGCCAGGCC
CFTR-C039  GTGCGCCAGTACGACAGCATCCAGAAACTGCTGAACGAGCGAAGCCTGTTCCGCCAGGCC
CFTR-C025  GTGAGGCAGTATGACTCCATCCAGAAGCTGCTGAACGAGAGAAGCCTGTTCAGGCAGGCC
CFTR-C050  GTGAGGCAGTATGACTCCATCCAGAAGCTGCTGAACGAGAGAAGCCTGTTCAGGCAGGCC
CFTR-C023  GTGCGCCAGTACGACAGCATCCAGAAGCTGCTCAATGAACGGAGCCTCTTTAGGCAGGCC
CFTR-C048  GTGCGCCAGTACGACAGCATCCAGAAGCTGCTCAATGAACGGAGCCTCTTTAGGCAGGCC
CFTR-C024  GTAAGGCAATATGACAGCATCCAAAAACTGCTTAATGAAAGGAGCCTCTTCAGGCAGGCC
CFTR-C049  GTAAGGCAATATGACAGCATCCAAAAACTGCTTAATGAAAGGAGCCTCTTCAGGCAGGCC
           **  * **.**.**.   ** **.**.**. * **.**.  *     ** **. * **.**
```

FIG. 10 (cont)

```
CFTR-WT    ATCAGCCCCTCCGACAGGGTGAAGCTCTTTCCCCACCGGAACTCAAGCAAGTGCAAGTCT
CFTR-C001  ATCAGCCCGAGCGACAGGGTGAAGCTGTTCCCCCATCGAAACAGCTCCAAGTGCAAGTCC
CFTR-C026  ATCAGCCCGAGCGACAGGGTGAAGCTGTTCCCCCATCGAAACAGCTCCAAGTGCAAGTCC
CFTR-C004  ATCTCGCCCAGCGATAGGGTGAAGCTGTTTCCCCATCGCAACAGCTCCAAGTGTAAGAGC
CFTR-C029  ATCTCGCCCAGCGATAGGGTGAAGCTGTTTCCCCATCGCAACAGCTCCAAGTGTAAGAGC
CFTR-C021  ATCAGCCCCAGCGATAGGGTGAAGCTGTTCCCCCATCGGAACTCCTCCAAGTGCAAGAGC
CFTR-C046  ATCAGCCCCAGCGATAGGGTGAAGCTGTTCCCCCATCGGAACTCCTCCAAGTGCAAGAGC
CFTR-C008  ATTAGCCCCAGCGACAGGGTGAAACTGTTTCCCCACAGGAACTCGTCCAAGTGCAAGAGC
CFTR-C033  ATTAGCCCCAGCGACAGGGTGAAACTGTTTCCCCACAGGAACTCGTCCAAGTGCAAGAGC
CFTR-C022  ATCTCCCCCTCCGACCGCGTGAAGCTGTTCCCCCATCGGAACTCCAGCAAGTGCAAGAGC
CFTR-C047  ATCTCCCCCTCCGACCGCGTGAAGCTGTTCCCCCATCGGAACTCCAGCAAGTGCAAGAGC
CFTR-C017  ATCAGCCCGTCCGATCGCGTGAAGCTGTTCCCCCACAGGAACTCATCCAAGTGCAAGAGC
CFTR-C042  ATCAGCCCGTCCGATCGCGTGAAGCTGTTCCCCCACAGGAACTCATCCAAGTGCAAGAGC
CFTR-C020  ATCTCCCCCAGCGACCGTGTGAAGCTGTTCCCCCACAGGAATTCCTCCAAATGCAAGAGC
CFTR-C045  ATCTCCCCCAGCGACCGTGTGAAGCTGTTCCCCCACAGGAATTCCTCCAAATGCAAGAGC
CFTR-C013  ATCAGCCCCTCCGACCGTGTGAAGCTGTTCCCCCACAGGAACAGCAGCAAGTGTAAGAGC
CFTR-C038  ATCAGCCCCTCCGACCGTGTGAAGCTGTTCCCCCACAGGAACAGCAGCAAGTGTAAGAGC
CFTR-C002  ATCAGCCCCTCCGACCGCGTGAAGCTGTTCCCCCACCGCAATAGCAGCAAATGCAAATCC
CFTR-C027  ATCAGCCCCTCCGACCGCGTGAAGCTGTTCCCCCACCGCAATAGCAGCAAATGCAAATCC
CFTR-C011  ATCAGCCCCAGCGACCGGGTCAAGCTGTTCCCCCACCGCAACTCCAGCAAGTGCAAGAGC
CFTR-C036  ATCAGCCCCAGCGACCGGGTCAAGCTGTTCCCCCACCGCAACTCCAGCAAGTGCAAGAGC
CFTR-C005  ATCAGCCCCAGCGACAGGGTCAAGCTGTTTCCCCACAGGAACAGCTCCAAGTGCAAGTCG
CFTR-C030  ATCAGCCCCAGCGACAGGGTCAAGCTGTTTCCCCACAGGAACAGCTCCAAGTGCAAGTCG
CFTR-C006  ATCAGCCCCAGCGATAGGGTGAAGCTGTTCCCCACACCGGAACTCCTCGAAGTGTAAGTCC
CFTR-C031  ATCAGCCCCAGCGATAGGGTGAAGCTGTTCCCCACACCGGAACTCCTCGAAGTGTAAGTCC
CFTR-C018  ATCTCCCCCAGCGACCGGGTGAAGCTGTTCCCCCACCGGAATAGCTCGAAGTGCAAGTCC
CFTR-C043  ATCTCCCCCAGCGACCGGGTGAAGCTGTTCCCCCACCGGAATAGCTCGAAGTGCAAGTCC
CFTR-C003  ATCTCCCCCTCCGATAGGGTGAAGCTGTTTCCACATCGGAACTCCAGTAAATGCAAGAGC
CFTR-C028  ATCTCCCCCTCCGATAGGGTGAAGCTGTTTCCACATCGGAACTCCAGTAAATGCAAGAGC
CFTR-C016  ATCAGTCCCTCGGACCGCGTGAAGCTGTTTCCCCACCGGAATAGCTCCAAGTGCAAGTCA
CFTR-C041  ATCAGTCCCTCGGACCGCGTGAAGCTGTTTCCCCACCGGAATAGCTCCAAGTGCAAGTCA
CFTR-C010  ATCAGCCCCAGCGACAGGGTGAAGCTGTTCCCCCACCGAAACAGCAGCAAATGCAAGTCC
CFTR-C035  ATCAGCCCCAGCGACAGGGTGAAGCTGTTCCCCCACCGAAACAGCAGCAAATGCAAGTCC
CFTR-C012  ATCAGCCCCAGCGACAGGGTGAAGCTGTTCCCCCACCGCAACTCCTCAAAATGCAAGAGC
CFTR-C037  ATCAGCCCCAGCGACAGGGTGAAGCTGTTCCCCCACCGCAACTCCTCAAAATGCAAGAGC
CFTR-C009  ATCTCGCCCAGCGACCGGGTGAAGCTGTTCCCCCATCGTAACAGCAGCAAATGCAAGAGC
CFTR-C034  ATCTCGCCCAGCGACCGGGTGAAGCTGTTCCCCCATCGTAACAGCAGCAAATGCAAGAGC
CFTR-C015  ATCAGCCCCAGCGATAGGGTGAAACTGTTCCCCCACCGGAACTCCAGCAAGTGCAAAAGC
CFTR-C040  ATCAGCCCCAGCGATAGGGTGAAACTGTTCCCCCACCGGAACTCCAGCAAGTGCAAAAGC
CFTR-C019  ATAAGCCCCAGCGATAGGGTCAAGCTCTTCCCGCACAGGAACAGCAGTAAATGCAAGTCA
CFTR-C044  ATAAGCCCCAGCGATAGGGTCAAGCTCTTCCCGCACAGGAACAGCAGTAAATGCAAGTCA
CFTR-C007  ATCAGCCCCAGCGACAGGGTCAAGCTCTTCCCACACCGAAACTCCTCCAAGTGCAAGTCC
CFTR-C032  ATCAGCCCCAGCGACAGGGTCAAGCTCTTCCCACACCGAAACTCCTCCAAGTGCAAGTCC
CFTR-C014  ATCAGCCCCAGCGACCGCGTGAAGCTCTTTCCCCACAGGAACAGCAGCAAATGCAAGTCC
CFTR-C039  ATCAGCCCCAGCGACCGCGTGAAGCTCTTTCCCCACAGGAACAGCAGCAAATGCAAGTCC
CFTR-C025  ATCAGCCCCTCCGACAGGGTGAAGCTGTTCCCCCATCGGAACAGCAGCAAGTGTAAGAGC
CFTR-C050  ATCAGCCCCTCCGACAGGGTGAAGCTGTTCCCCCATCGGAACAGCAGCAAGTGTAAGAGC
CFTR-C023  ATCAGCCCGAGCGACAGGGTCAAGCTGTTCCCACCGCAACAGCTCCAAATGCAAAAGC
CFTR-C048  ATCAGCCCGAGCGACAGGGTCAAGCTGTTCCCACCGCAACAGCTCCAAATGCAAAAGC
CFTR-C024  ATCTCCCCCTCCGACCGAGTGAAACTGTTCCCCCATAGAAATAGCAGCAAATGCAAATCC
CFTR-C049  ATCTCCCCCTCCGACCGAGTGAAACTGTTCCCCCATAGAAATAGCAGCAAATGCAAATCC
           **    **    **. * ** **.**.**.** **. * **.       **.**.**.
```

FIG. 10 (cont)

```
CFTR-WT    AAGCCCCAGATTGCTGCTCTGAAAGAGGAGACAGAAGAAGAGGTGCAAGATACAAGGCTT  ← SEQ ID NO:2
CFTR-C001  AAGCCCCAGATCGCGGCTCTGAAGGAGGAGACGGAGGAAGAGGTGCAGGATACCAGGCTG  ← SEQ ID NO:5
CFTR-C026  AAGCCCCAGATCGCGGCTCTGAAGGAGGAGACGGAGGAAGAGGTGCAGGATACCAGGCTG  ← SEQ ID NO:30
CFTR-C004  AAGCCCCAGATCGCCGCCCTGAAGGAAGAGACCGAGGAGGAGGTGCAGGACACCAGGCTT  ← SEQ ID NO:8
CFTR-C029  AAGCCCCAGATCGCCGCCCTGAAGGAAGAGACCGAGGAGGAGGTGCAGGACACCAGGCTT  ← SEQ ID NO:33
CFTR-C021  AAGCCACAGATCGCCGCGCTGAAGGAGGAGACCGAGGAGGAAGTCCAGGACACCCGGCTG  ← SEQ ID NO:25
CFTR-C046  AAGCCACAGATCGCCGCGCTGAAGGAGGAGACCGAGGAGGAAGTCCAGGACACCCGGCTG  ← SEQ ID NO:50
CFTR-C008  AAGCCCCAGATCGCCGCCCTGAAGGAGGAGACCGAGGAGGAGGTGCAGGACACCAGGCTG  ← SEQ ID NO:12
CFTR-C033  AAGCCCCAGATCGCCGCCCTGAAGGAGGAGACCGAGGAGGAGGTGCAGGACACCAGGCTG  ← SEQ ID NO:37
CFTR-C022  AAGCCCCAGATCGCCGCCCTGAAGGAGGAGACCGAGGAGGAGGTGCAGGACACCAGGCTC  ← SEQ ID NO:26
CFTR-C047  AAGCCCCAGATCGCCGCCCTGAAGGAGGAGACCGAGGAGGAGGTGCAGGACACCAGGCTC  ← SEQ ID NO:51
CFTR-C017  AAGCCACAGATCGCTGCCCTCAAGGAGGAGACCGAGGAGGAAGTGCAGGACACCAGGCTC  ← SEQ ID NO:21
CFTR-C042  AAGCCACAGATCGCTGCCCTCAAGGAGGAGACCGAGGAGGAAGTGCAGGACACCAGGCTC  ← SEQ ID NO:46
CFTR-C020  AAGCTGCAGATCGCCGCGCTGAAGGAGGAGACCGAAGAGGAAGTCCAGGATACGAGGCTG  ← SEQ ID NO:24
CFTR-C045  AAGCCGCAGATCGCCGCGCTGAAGGAGGAGACCGAAGAGGAAGTCCAGGATACGAGGCTG  ← SEQ ID NO:49
CFTR-C013  AAGCCCCAGATAGCCGCCCTGAAGGAGGAGACCGAGGAGGAACTGCAGGACACCCGGCTG  ← SEQ ID NO:17
CFTR-C038  AAGCCCCAGATAGCCGCCCTGAAGGAGGAGACCGAGGAGGAAGTGCAGGACACCCGGCTG  ← SEQ ID NO:42
CFTR-C002  AAACCCCAGATCGCCGCCCTGAAGGAGGAGACCGAGGAGGAGGTCCAAGATACCAGGCTG  ← SEQ ID NO:6
CFTR-C027  AAACCCCAGATCGCCGCCCTGAAGGAGGAGACCGAGGAGGAGGTCCAAGATACCAGGCTG  ← SEQ ID NO:31
CFTR-C011  AAACCCCAGATCGCCGCACTGAAGGAGGAGACGGAGGAGGAGGTGCAAGACACCCGCCTG  ← SEQ ID NO:15
CFTR-C036  AAACCCCAGATCGCCGCACTGAAGGAGGAGACGGAGGAGGAGGTGCAAGACACCCGCCTG  ← SEQ ID NO:40
CFTR-C005  AAGCCCCAGATCGCGGCCCTGAAGGAGGAGACCGAGGAAGAGGTGCAGGACACCAGGCTG  ← SEQ ID NO:9
CFTR-C030  AAGCCCCAGATCGCGGCCCTGAAGGAGGAGACCGAGGAAGAGGTGCAGGACACCAGGCTG  ← SEQ ID NO:34
CFTR-C006  AAGCCCCAAATAGCCGCCCTCAAGGAGGAGACCGAGGAGGAGGTGCAGGACACCCGGCTG  ← SEQ ID NO:10
CFTR-C031  AAGCCCCAAATAGCCGCCCTCAAGGAGGAGACCGAGGAGGAGGTGCAGGACACCCGGCTG  ← SEQ ID NO:35
CFTR-C018  AAACCCCAGATCGCAGCCCTAAAGGAGGAGACGGAAGAGGAGGTGCAGGACACCCGGCTC  ← SEQ ID NO:22
CFTR-C043  AAACCCCAGATCGCAGCCCTAAAGGAGGAGACGGAAGAGGAGGTGCAGGACACCCGGCTC  ← SEQ ID NO:47
CFTR-C003  AAGCCCCAGATCGCCGCCCTGAAGGAAGAGACCGAAGAGGAGGTGCAGGACACCCGACTG  ← SEQ ID NO:7
CFTR-C028  AAGCCCCAGATCGCCGCCCTGAAGGAAGAGACCGAAGAGGAGGTGCAGGACACCCGACTG  ← SEQ ID NO:32
CFTR-C016  AAGCCCCAGATCGCCGCCCTGAAGGAGGAGACCGAGGAGGAGGTGCAGGATACCCGCCTG  ← SEQ ID NO:20
CFTR-C041  AAGCCCCAGATCGCCGCCCTGAAGGAGGAGACCGAGGAGGAGGTGCAGGATACCCGCCTG  ← SEQ ID NO:45
CFTR-C010  AAGCCCCAGATCGCCGCGCTGAAAGAGGAAACAGAGGAGGAGGTACAGGACACACGGCTA  ← SEQ ID NO:14
CFTR-C035  AAGCCCCAGATCGCCGCGCTGAAAGAGGAAACAGAGGAGGAGGTACAGGACACACGGCTA  ← SEQ ID NO:39
CFTR-C012  AAGCCCCAGATCGCCGCCCTCAAGGAGGAAACCGAGGAGGAGGTCCAGGACACCCGGCTG  ← SEQ ID NO:16
CFTR-C037  AAGCCCCAGATCGCCGCCCTCAAGGAGGAAACCGAGGAGGAGGTCCAGGACACCCGGCTG  ← SEQ ID NO:41
CFTR-C009  AAGCCCCAGATTGCCGCCCTGAAGGAAGAGACCGAGGAGGAGGTGCAAGACACGCGCCTG  ← SEQ ID NO:13
CFTR-C034  AAGCCCCAGATTGCCGCCCTGAAGGAAGAGACCGAGGAGGAGGTGCAAGACACGCGCCTG  ← SEQ ID NO:38
CFTR-C015  AAGCCCCAGATCGCCGCCCTGAAGGAGGAGACCGAGGAGGAAGTGCAGGACACCAGGCTG  ← SEQ ID NO:19
CFTR-C040  AAGCCCCAGATCGCCGCCCTGAAGGAGGAGACCGAGGAGGAAGTGCAGGACACCAGGCTG  ← SEQ ID NO:44
CFTR-C019  AAGCCCCAGATCGCCGCCCTGAAGGAGGAAACCGAGGAGGAGGTGCAGGACACCCGCCTG  ← SEQ ID NO:23
CFTR-C044  AAGCCCCAGATCGCCGCCCTGAAGGAGGAAACCGAGGAGGAGGTGCAGGACACCCGCCTG  ← SEQ ID NO:48
CFTR-C007  AAGCCCCAGATCGCCGCGCTGAAGGAAGAGACCGAGGAGGAGGTCCAGGACACCCGGCTG  ← SEQ ID NO:11
CFTR-C032  AAGCCCCAGATCGCCGCGCTGAAGGAAGAGACCGAGGAGGAGGTCCAGGACACCCGGCTG  ← SEQ ID NO:36
CFTR-C014  AAGCCGCAGATCGCGGCCCTCAAGGAGGAGACCGAGGAGGAGGTGCAGGACACGCGTCTG  ← SEQ ID NO:18
CFTR-C039  AAGCCGCAGATCGCGGCCCTCAAGGAGGAGACCGAGGAGGAGGTGCAGGACACGCGTCTG  ← SEQ ID NO:43
CFTR-C025  AAGCCGCAGATCGCCGCCCTCAAAGAGGAGACCGAGGAAGAAGTGCAGGACACGCGTCTG  ← SEQ ID NO:29
CFTR-C050  AAGCCGCAGATCGCCGCCCTCAAAGAGGAGACCGAGGAAGAAGTGCAGGACACGCGTCTG  ← SEQ ID NO:54
CFTR-C023  AAGCCCCAGATCGCGGCCCTGAAGGAAGAGACCGAGGAAGAGGTGCAGGACACCAGGCTC  ← SEQ ID NO:27
CFTR-C048  AAGCCCCAGATCGCGGCCCTGAAGGAAGAGACCGAGGAAGAGGTGCAGGACACCAGGCTC  ← SEQ ID NO:52
CFTR-C024  AAGCCCCAAATCGCCGCCCTGAAGGAGGAGACGGAGGAGGAGGTGCAAGACACCCGGCTG  ← SEQ ID NO:28
CFTR-C049  AAGCCCCAAATCGCCGCCCTGAAGGAGGAGACGGAGGAGGAGGTGCAAGACACCCGGCTG  ← SEQ ID NO:53
           **,**  **,** **  **  **,**,**,** **,**,**,** **,**,**   *  **
```

FIG. 10 (cont)

POLYNUCLEOTIDES ENCODING CYSTIC FIBROSIS TRANSMEMBRANE CONDUCTANCE REGULATOR FOR THE TREATMENT OF CYSTIC FIBROSIS

RELATED APPLICATIONS

This application is the National Stage of International Application No. PCT/US2017/033419, filed on May 18, 2017, which claims the benefit under 35 U.S.C. § 119(e) of U.S. provisional application No. 62/338,492, filed on May 18, 2016. The disclosure of the prior applications is incorporated herein by reference in their entirety.

REFERENCE TO A SEQUENCE LISTING SUBMITTED ELECTRONICALLY VIA EFS-WEB

The content of the electronically submitted sequence listing (Name: SEQUENCE_LISTING.TXT, Size: 693,568 bytes; and Date of Creation: Nov. 15, 2018) is herein incorporated by reference in its entirety.

BACKGROUND

Cystic Fibrosis ("CF") is an autosomal recessive disease characterized by the abnormal buildup of sticky and thick mucus in patients. CF is also known as cystic fibrosis of the pancreas, fibrocystic disease of the pancreas, or muscoviscidosis. Mucus is an important bodily fluid that lubricates and protects the lungs, reproductive system, digestive system, and other organs. However, CF patients produce thick and sticky mucus, which reduces the size of the airways leading to chronic coughing, wheezing, inflammation, bacterial infections, fibrosis, and cysts in the lungs. Additionally, most CF patients have mucus blocking the ducts in the pancreas, which prevents the release of insulin and digestive enzymes leading to diarrhea, malnutrition, poor growth, and weight loss. Gershman A. J. et al., Cleve Clin J Med. 73: 1065-1074 (2006). CF has an estimated incidence of 1 in 2,500 to 3,500 in Caucasian births, but is much more rare in other populations. Ratjen F. et al., Lancet 361: 681-689 (2003). Current treatment for CF only controls the symptoms and does not cure the disease. Specifically, antibiotics, anti-inflammatory drugs, bronchodilators, decongestants, a diet high in protein and fat, and vitamin supplements are prescribed to control the symptoms. In advanced lung disease, lung transplants have also been performed to provide a patient with undamaged lungs. However, none of these treatments completely or reliably controls the disease. As such, there is a need for improved therapy to treat CF.

The principal gene associated with CF is Cystic Fibrosis Transmembrane Conductance Regulator ("CFTR") (NM_000492, NP_000483; XM_011515751, XP_011514053; XM_011515752, XP_011514054; XM_011515753, XP_011514055; XM_011515754, XP_011514056; also referred to as ATP-Binding Cassette Sub-Family C, Member 7 ("ABCC7")). CFTR is an enzyme (E.C. 3.6.3.49) that plays a critical role in transport pathways and functions as a chloride ion channel. Lack of functional CFTR prevents excretion of chloride ions and leads to increased sodium ion absorption. Welsh, M. J. et al., J. Clin. Invest. 80: 1523-1526 (1987). This causes water to move from the mucus to cells resulting in a more viscous mucus. CFTR localizes to the cytoplasm, endosomes, extracellular space, and plasma membrane of cells. The protein is 1480 amino acids long. A complete or partial loss of CFTR function leads to thick and sticky mucus causing difficulty breathing, digestive problems, and shortened life span.

There is no currently available therapeutic to treat CF. Thus, there remains a need in the art for methods of treating the disease.

BRIEF SUMMARY

The present disclosure provides mRNA therapeutics for the treatment of cystic fibrosis (CF). The mRNA therapeutics of the disclosure are particularly well-suited for the treatment of CF as the technology provides for the intracellular delivery of mRNA encoding CFTR followed by de novo synthesis of functional CFTR protein within target cells. The instant disclosure features the incorporation of modified nucleotides within therapeutic mRNAs to (1) minimize unwanted immune activation (e.g., the innate immune response associated with the in vivo introduction of foreign nucleic acids) and (2) optimize the translation efficiency of mRNA to protein. Exemplary aspects of the disclosure feature a combination of nucleotide modification to reduce the innate immune response and sequence optimization, in particular, within the open reading frame (ORF) of therapeutic mRNAs encoding CFTR to enhance protein expression.

The mRNA therapeutic technology of the instant disclosure also features delivery of mRNA encoding CFTR via a lipid nanoparticle (LNP) delivery system. The instant disclosure features novel ionizable lipid-based LNPs which have improved properties when administered in vivo, for example, cellular uptake, intracellular transport and/or endosomal release or endosomal escape. The LNPs of the disclosure also demonstrate reduced immunogenicity associated with the in vivo administration of LNPs.

In certain aspects, the present disclosure relates to compositions and delivery formulations comprising a polynucleotide, e.g., a ribonucleic acid (RNA), e.g., a messenger RNA (mRNA), encoding cystic fibrosis transmembrane conductance regulator and methods for treating acute cystic fibrosis (CF) in a subject in need thereof by administering the same.

The present disclosure provides, in certain aspects, a polynucleotide comprising an open reading frame (ORF) encoding a cystic fibrosis transmembrane conductance regulator (CFTR) polypeptide, wherein the uracil or thymine content of the ORF is between 100% and about 150% of the theoretical minimum uracil or thymine content of a nucleotide sequence encoding the CFTR polypeptide (% $U_{TM}$ or % $T_{TM}$, respectively).

In some embodiments, the uracil or thymine content in the ORF is between about 105% and about 145%, about 105% and about 140%, about 110% and about 140%, about 110% and about 145%, about 115% and about 135%, about 105% and about 135%, about 110% and about 135%, about 115% and about 145%, or about 115% and about 140% of the % $U_{TM}$ or % $T_{TM}$.

In some embodiments, the uracil or thymine content in the ORF is between (i) 110%, 111%, 112%, 113%, 114%, 115%, 116%, 117%, 118%, or 119% and (ii) 120%, 121%, 122%, 123%, 124%, 125%, or 126% of the % $U_{TM}$ or % $T_{TM}$.

In some embodiments, the uracil or thymine content in the ORF is less than the uracil or thymine content in the corresponding wild-type ORF (% $U_{WT}$ or % $T_{WT}$).

In some embodiments, the uracil or thymine content in the ORF is less than about 95%, less than about 90%, less than about 85%, less than 80%, less than 75%, less than 74%, less than 73%, less than 72%, less than 71%, less than 70%, less than 69%, or less than 68% of the % $U_{WT}$ or % $T_{WT}$.

In some embodiments, the uracil or thymine content in the ORF is between 64% and 68% of the % $U_{WT}$ or % $T_{WT}$.

In some embodiments, the uracil or thymine content in the ORF is less than about 50%, less than about 40%, less than about 30%, or less than about 20% of the total nucleotide content in the ORF.

In some embodiments, the uracil or thymine content in the ORF is less than about 20% of the total nucleotide content in the ORF.

In some embodiments, the uracil or thymine content in the ORF is between about 17% and about 19% of the total nucleotide content in the ORF.

In some embodiments, the guanine content in the ORF is less than 100%, less than about 90%, less than about 85%, less than about 80%, or less than about 75% of the theoretical maximum guanine content of a nucleotide sequence encoding the CFTR polypeptide (% $G_{TMX}$).

In some embodiments, the guanine content in the ORF is between about 70% and about 80%, between about 72% and about 78%, or between about 73% and about 77% of the % $G_{TMX}$.

In some embodiments, the cytosine content in the ORF is less than 95% of the theoretical maximum cytosine content in a nucleotide sequence encoding the CFTR polypeptide (% $C_{TMX}$).

In some embodiments, the cytosine content in the ORF is between about 60% and about 80%, between about 65% and about 75%, between about 67% and about 74%, or between about 69% and about 72% of the % $C_{TMX}$.

In some embodiments, the guanine and cytosine content (G/C) of the ORF is less than 100%, less than 99%, less than 98%, less than 97%, less than 96%, less than 95%, less than 94%, or less than 93% of the theoretical maximum G/C content in a nucleotide sequence encoding the CFTR polypeptide (% $G/C_{TMX}$).

In some embodiments, the G/C content in the ORF is between about 80% and about 100%, between about 85% and about 99%, between about 90% and about 97%, or between about 91% and about 94% of the % $G/C_{TMX}$.

In some embodiments, the G/C content in the ORF is at least 2%, at least 3%, at least 4%, at least 5%, at least 6%, at least 7%, at least about 10%, at least about 15%, at least about 20%, at least about 25%, at least about 30%, at least about 35%, or at least about 40% higher than the G/C content in the corresponding wild-type ORF (% $G/C_{WT}$).

In some embodiments, the average G/C content in the 3rd codon position in the ORF is at least 20%, at least 21%, at least 22%, at least 23%, at least 24%, at least 25%, at least 26%, at least 27%, at least 28%, at least 29%, or at least 30% higher than the average G/C content in the $3^{rd}$ codon position in the corresponding wild-type ORF.

In some embodiments, the ORF further comprises at least one low-frequency codon.

In some embodiments, the ORF is at least 91%, at least 92%, at least 93%, at least 94%, at least 95%, at least 96%, at least 97%, at least 98%, at least 99%, or 100% identical to CFTR-CO8, CFTR-CO33, CFTR-CO17, CFTR-CO42, CFTR-CO4, CFTR-CO29, CFTR-CO13, CFTR-CO38, CFTR-CO22, CFTR-CO5, CFTR-CO21, CFTR-CO30, CFTR-CO46, CFTR-CO47, CFTR-CO20, or CFTR-CO45;

In some embodiments, the ORF is at least 90%, at least 91%, at least 92%, at least 93%, at least 94%, at least 95%, at least 96%, at least 97%, at least 98%, at least 99%, or 100% identical to CFTR-CO1, CFTR-CO26, CFTR-CO11, CFTR-CO36, CFTR-CO15, CFTR-CO24, CFTR-CO40, CFTR-CO49, CFTR-CO2, CFTR-CO19, CFTR-CO27, CFTR-CO44, CFTR-CO7, CFTR-CO32, CFTR-CO9, CFTR-CO34, CFTR-CO14, CFTR-CO39, CFTR-CO10, CFTR-CO35, CFTR-CO3, CFTR-CO28, CFTR-CO25, CFTR-CO50, CFTR-CO16, CFTR-CO41, CFTR-CO18, CFTR-CO43, CFTR-CO12, or CFTR-CO37; or In some embodiments, the ORF is at least 89%, at least 90%, at least 91%, at least 92%, at least 93%, at least 94%, at least 95%, at least 96%, at least 97%, at least 98%, at least 99%, or 100% identical to CFTR-CO23, CFTR-CO48, CFTR-CO6, or CFTR-CO31.

The present disclosure provides, in certain aspects, a polynucleotide comprising an ORF, (i) wherein the ORF is at least 91%, at least 92%, at least 93%, at least 94%, at least 95%, at least 96%, at least 97%, at least 98%, at least 99%, or 100% identical to CFTR-CO8, CFTR-CO33, CFTR-CO17, CFTR-CO42, CFTR-CO4, CFTR-CO29, CFTR-CO13, CFTR-CO38, CFTR-CO22, CFTR-CO5, CFTR-CO21, CFTR-CO30, CFTR-CO46, CFTR-CO47, CFTR-CO20, or CFTR-CO45; (ii) wherein the ORF is at least 90%, at least 91%, at least 92%, at least 93%, at least 94%, at least 95%, at least 96%, at least 97%, at least 98%, at least 99%, or 100% identical to CFTR-CO1, CFTR-CO26, CFTR-CO11, CFTR-CO36, CFTR-CO15, CFTR-CO24, CFTR-CO40, CFTR-CO49, CFTR-CO2, CFTR-CO19, CFTR-CO27, CFTR-CO44, CFTR-CO7, CFTR-CO32, CFTR-CO9, CFTR-CO34, CFTR-CO14, CFTR-CO39, CFTR-CO10, CFTR-CO35, CFTR-CO3, CFTR-CO28, CFTR-CO25, CFTR-CO50, CFTR-CO16, CFTR-CO41, CFTR-CO18, CFTR-CO43, CFTR-CO12, or CFTR-CO37; or (iii) wherein the ORF is at least 89%, at least 90%, at least 91%, at least 92%, at least 93%, at least 94%, at least 95%, at least 96%, at least 97%, at least 98%, at least 99%, or 100% identical to CFTR-CO23, CFTR-CO48, CFTR-CO6, or CFTR-CO31.

In some embodiments, the ORF has at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 5 to 54.

In some embodiments, the CFTR polypeptide comprises an amino acid sequence at least at least about 89%, at least about 90%, at least about 91%, at least about 92%, at least about 93%, at least about 94%, about 95%, at least about 96%, at least about 97%, at least about 98%, at least about 99%, or about 100% identical to the polypeptide sequence of wild type CFTR (SEQ ID NO: 1), and wherein the CFTR polypeptide has chloride ion channel activity.

In some embodiments, the CFTR polypeptide is a variant, derivative, or mutant having chloride ion channel activity.

In some embodiments, the polynucleotide sequence further comprises a nucleotide sequence encoding a transit peptide.

In some embodiments, the polynucleotide is single stranded.

In some embodiments, the polynucleotide is double stranded.

In some embodiments, the polynucleotide is DNA.

In some embodiments, the polynucleotide is RNA.

In some embodiments, the polynucleotide is mRNA.

In some embodiments, the polynucleotide comprises at least one chemically modified nucleobase.

In some embodiments, the at least one chemically modified nucleobase is selected from the group consisting of pseudouracil (ψ), N1-methylpseudouracil (m1ψ), 2-thiouracil (s2U), 4'-thiouracil, 5-methylcytosine, 2-thio-1-methyl-1-deaza-pseudouracil, 2-thio-1-methyl-pseudouracil, 2-thio-5-aza-uracil, 2-thio-dihydropseudouracil, 2-thio-dihydrouracil, 2-thio-pseudouracil, 4-methoxy-2-thiopseudouracil, 4-methoxy-pseudouracil, 4-thio-1-methyl-pseudouracil, 4-thio-pseudouracil, 5-aza-uracil, dihydropseudouracil, 5-methyluracil, 5-methoxyuracil, 2'-O-methyl uracil, 1-methyl-pseudouracil (m1ψ), 5-methyl-cytosine (m5C), α-thio-guanine, α-thio-adenine, 5-cyano uracil, 4'-thio uracil, 7-deaza-adenine, 1-methyl-adenine (m1A), 2-methyl-adenine (m2A), N6-methyl-adenine (m6A), and 2,6-Diaminopurine, (I), 1-methyl-inosine (m1I), wyosine (imG), methylwyosine (mimG), 7-deaza-guanine, 7-cyano-7-deaza-guanine (preQ0), 7-aminomethyl-7-deaza-guanine (preQ1), 7-methyl-guanine (m7G), 1-methyl-guanine (m1G), 8-oxo-guanine, 7-methyl-8-oxo-guanine, and two or more combinations thereof.

In some embodiments, the at least one chemically modified nucleobase is 5-methoxyuracil.

In some embodiments, at least about 25%, at least about 30%, at least about 40%, at least about 50%, at least about 60%, at least about 70%, at least about 80%, at least about 90%, at least about 95%, at least about 99%, or 100% of the uracils are 5-methoxyuracils.

In some embodiments, the polynucleotide further comprises a miRNA binding site.

In some embodiments, the miRNA binding site comprises one or more nucleotide sequences selected from TABLE 4.

In some embodiments, the miRNA binding site binds to miR-142.

In some embodiments, the miRNA binding site binds to miR-142-3p or miR-142-5p.

In some embodiments, the miR$_{142}$ binding site comprises SEQ ID NO: 98.

In some embodiments, the polynucleotide further comprises a 5' UTR.

In some embodiments, the 5' UTR comprises a nucleic acid sequence at least 90%, at least about 95%, at least about 96%, at least about 97%, at least about 98%, at least about 99%, or about 100% identical to a sequence selected from the group consisting of SEQ ID NOs: 55-97.

In some embodiments, the polynucleotide further comprises a 3' UTR.

In some embodiments, the 3' UTR comprises a nucleic acid sequence at least about 90%, at least about 95%, at least about 96%, at least about 97%, at least about 98%, at least about 99%, or about 100% identical to a selected from the group consisting of SEQ ID NOs: 55-97.

In some embodiments, the miRNA binding site is located within the 3' UTR.

In some embodiments, the polynucleotide further comprises a 5' terminal cap.

In some embodiments, the 5' terminal cap comprises a Cap0, Cap1, ARCA, inosine, N1-methyl-guanosine, 2'-fluoro-guanosine, 7-deaza-guanosine, 8-oxo-guanosine, 2-amino-guanosine, LNA-guanosine, 2-azidoguanosine, Cap2, Cap4, 5' methylG cap, or an analog thereof.

In some embodiments, the polynucleotide further comprises a poly-A region.

In some embodiments, the poly-A region is at least about 10, at least about 20, at least about 30, at least about 40, at least about 50, at least about 60, at least about 70, at least about 80, or at least about 90 nucleotides in length.

In some embodiments, the poly-A region has about 10 to about 200, about 20 to about 180, about 50 to about 160, about 70 to about 140, about 80 to about 120 nucleotides in length.

In some embodiments, the polynucleotide encodes a CFTR polypeptide that is fused to one or more heterologous polypeptides.

In some embodiments, the one or more heterologous polypeptides increase a pharmacokinetic property of the CFTR polypeptide.

In some embodiments, upon administration to a subject, the polynucleotide has:
  (i) a longer plasma half-life;
  (ii) increased expression of a CFTR polypeptide encoded by the ORF;
  (iii) a lower frequency of arrested translation resulting in an expression fragment;
  (iv) greater structural stability; or
  (v) any combination thereof,
relative to a corresponding polynucleotide comprising SEQ ID NO: 2.

In some embodiments, the polynucleotide comprises:
  (i) a 5'-terminal cap;
  (ii) a 5'-UTR;
  (iii) an ORF encoding a CFTR polypeptide;
  (iv) a 3'-UTR; and
  (v) a poly-A region.

In some embodiments, the 3'-UTR comprises a miRNA binding site.

The present disclosure provides, in certain embodiments, a method of producing a polynucleotide as described herein, the method comprising modifying an ORF encoding a CFTR polypeptide by substituting at least one uracil nucleobase with an adenine, guanine, or cytosine nucleobase, or by substituting at least one adenine, guanine, or cytosine nucleobase with a uracil nucleobase, wherein all the substitutions are synonymous substitutions.

In some embodiments, the method further comprises replacing at least about 90%, at least about 95%, at least about 99%, or about 100% of uracils with 5-methoxyuracils.

The present disclosure provides, in certain aspects, a composition comprising
  (a) a polynucleotide as described herein; and
  (b) a delivery agent.

In some embodiments, the delivery agent comprises a lipidoid, a liposome, a lipoplex, a lipid nanoparticle, a polymeric compound, a peptide, a protein, a cell, a nanoparticle mimic, a nanotube, or a conjugate.

In some embodiments, the delivery agent comprises a lipid nanoparticle.

In some embodiments, the lipid nanoparticle comprises a lipid selected from the group consisting of DLin-DMA, DLin-K-DMA, 98N12-5, $C_{12}$-200, DLin-MC3-DMA, DLin-KC2-DMA, DODMA, PLGA, PEG, PEG-DMG, PEGylated lipids, amino alcohol lipids, KL22, and any combinations thereof.

In some embodiments, the delivery agent comprises a compound having the Formula (I)

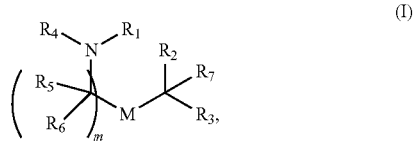

or a salt or stereoisomer thereof, wherein
  $R_1$ is selected from the group consisting of $C_{5-20}$ alkyl, $C_{5-20}$ alkenyl, —R*YR", —YR", and —R"M'R';
  $R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, —$(CH_2)_nQ$, —$(CH_2)_nCHQR$, —CHQR, —$CQ(R)_2$, and unsubstituted $C_{1-6}$ alkyl, where Q is selected from a carbocycle, heterocycle, —OR, —$O(CH_2)_nN(R)_2$, —C(O)OR, —OC(O)R, —$CX_3$, —$CX_2H$, —$CXH_2$, —CN, —$N(R)_2$, —$C(O)N(R)_2$, —N(R)C(O)R, —$N(R)S(O)_2R$, —N(R)C(O)N$(R)_2$, —$N(R)C(S)N(R)_2$, and —$C(R)N(R)_2C(O)OR$, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13; and provided when $R_4$ is —$(CH_2)_nQ$, —$(CH_2)_nCHQR$, —CHQR, or —$CQ(R)_2$, then (i) Q is not —$N(R)_2$ when n is 1, 2, 3, 4 or 5, or (ii) Q is not 5, 6, or 7-membered heterocycloalkyl when n is 1 or 2.

The present disclosure provides, in certain aspects, a composition comprising a nucleotide sequence encoding a CFTR polypeptide and a delivery agent, wherein the delivery agent comprises a compound having the Formula (I)

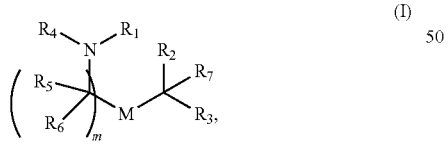

(I)

or a salt or stereoisomer thereof, wherein $R_1$ is selected from the group consisting of $C_{5-20}$ alkyl, $C_{5-20}$ alkenyl, —R*YR", —YR", and —R"M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, —$(CH_2)_nQ$, —$(CH_2)_nCHQR$, —CHQR, —$CQ(R)_2$, and unsubstituted $C_{1-6}$ alkyl, where Q is selected from a carbocycle, heterocycle, —OR, —$O(CH_2)_nN(R)_2$, —C(O)OR, —OC(O)R, —$CX_3$, —$CX_2H$, —$CXH_2$, —CN, —$N(R)_2$, —$C(O)N(R)_2$, —N(R)C(O)R, —$N(R)S(O)_2R$, —N(R)C(O)N$(R)_2$, —$N(R)C(S)N(R)_2$, and —$C(R)N(R)_2C(O)OR$, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13; and provided when $R_4$ is —$(CH_2)_nQ$, —$(CH_2)_nCHQR$, —CHQR, or —$CQ(R)_2$, then (i) Q is not —$N(R)_2$ when n is 1, 2, 3, 4 or 5, or (ii) Q is not 5, 6, or 7-membered heterocycloalkyl when n is 1 or 2.

In some embodiments, the compound is of Formula (IA):

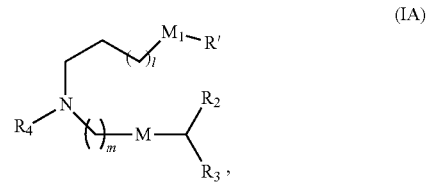

(IA)

or a salt or stereoisomer thereof, wherein l is selected from 1, 2, 3, 4, and 5;

m is selected from 5, 6, 7, 8, and 9;

$M_1$ is a bond or M';

$R_4$ is unsubstituted $C_{1-3}$ alkyl, or —$(CH_2)_nQ$, in which n is 1, 2, 3, 4, or 5 and Q is OH, —$NHC(S)N(R)_2$, or —$NHC(O)N(R)_2$;

M and M' are independently selected from —C(O)O—, —OC(O)—, —C(O)N(R')—, —P(O)(OR')O—, an aryl group, and a heteroaryl group; and $R_2$ and $R_3$ are independently selected from the group consisting of H, $C_{1-14}$ alkyl, and $C_{2-14}$ alkenyl.

In some embodiments, m is 5, 7, or 9.

In some embodiments, the compound is of Formula (II):

(II)

[Chemical structure of Formula (II)]

or a salt or stereoisomer thereof, wherein 1 is selected from 1, 2, 3, 4, and 5;

$M_1$ is a bond or M';

$R_4$ is unsubstituted $C_{1-3}$ alkyl, or —$(CH_2)_nQ$, in which n is 2, 3, or 4 and Q is OH, —$NHC(S)N(R)_2$, or —$NHC(O)N(R)_2$;

M and M' are independently selected from —C(O)O—, —OC(O)—, —C(O)N(R')—, —P(O)(OR')O—, an aryl group, and a heteroaryl group; and $R_2$ and $R_3$ are independently selected from the group consisting of H, $C_{1-14}$ alkyl, and $C_{2-14}$ alkenyl.

In some embodiments, $M_1$ is M'.

In some embodiments, M and M' are independently —C(O)O— or —OC(O)—.

In some embodiments, 1 is 1, 3, or 5.

In some embodiments, the compound is selected from the group consisting of Compound 1 to Compound 232, salts and isomers thereof, and any combination thereof.

In some embodiments, the compound is of the Formula (IIa), (IIa)

[Chemical structure of Formula (IIa)]

or a salt or stereoisomer thereof.

In some embodiments, the compound is of the Formula (IIb), (IIb)

[Chemical structure of Formula (IIb)]

or a salt or stereoisomer thereof.

In some embodiments, the compound is of the Formula (IIc) or (IIe), (IIc)

[Chemical structure of Formula (IIc)]

(IIe)

[Chemical structure of Formula (IIe)]

or a salt or stereoisomer thereof.

In some embodiments, $R_4$ is selected from —$(CH_2)_nQ$ and —$(CH_2)_nCHQR$.

In some embodiments, the compound is of the Formula (IId), (IId)

[Chemical structure of Formula (IId)]

or a salt or stereoisomer thereof, wherein $R_2$ and $R_3$ are independently selected from the group consisting of $C_{5-14}$ alkyl and $C_{5-14}$ alkenyl, n is selected from 2, 3, and 4, and R', R", $R_5$, $R_6$ and m are as defined above.

In some embodiments, $R_2$ is $C_8$ alkyl.

In some embodiments, $R_3$ is $C_5$ alkyl, $C_6$ alkyl, $C_7$ alkyl, $C_8$ alkyl, or $C_9$ alkyl.

In some embodiments, m is 5, 7, or 9.

In some embodiments, each $R_5$ is H.

In some embodiments, each $R_6$ is H.

In some embodiments, the composition is a nanoparticle composition.

In some embodiments, the delivery agent further comprises a phospholipid.

In some embodiments, the phospholipid is selected from the group consisting of
1,2-dilinoleoyl-sn-glycero-3-phosphocholine (DLPC), 1,2-dimyristoyl-sn-glycero-phosphocholine (DMPC), 1,2-dioleoyl-sn-glycero-3-phosphocholine (DOPC), 1,2-dipalmitoyl-sn-glycero-3-phosphocholine (DPPC), 1,2-distearoyl-sn-glycero-3-phosphocholine (DSPC), 1,2-diundecanoyl-sn-glycero-phosphocholine (DUPC), 1-palmitoyl-2-oleoyl-sn-glycero-3-phosphocholine (POPC), 1,2-di-O-octadecenyl-sn-glycero-3-phosphocholine (18:0 Diether PC), 1-oleoyl-2-cholesterylhemisuccinoyl-sn-glycero-3-phosphocholine (OChemsPC), 1-hexadecyl-sn-glycero-3-phosphocholine (C16 Lyso PC), 1,2-dilinolenoyl-sn-glycero-3-phosphocholine, 1,2-diarachidonoyl-sn-glycero-3-phosphocholine,
1,2-didocosahexaenoyl-sn-glycero-3-phosphocholine,
1,2-dioleoyl-sn-glycero-3-phosphoethanolamine (DOPE),
1,2-diphytanoyl-sn-glycero-3-phosphoethanolamine (ME 16:0 PE),
1,2-distearoyl-sn-glycero-3-phosphoethanolamine,
1,2-dilinoleoyl-sn-glycero-3-phosphoethanolamine,
1,2-dilinolenoyl-sn-glycero-3-phosphoethanolamine,
1,2-diarachidonoyl-sn-glycero-3-phosphoethanolamine,
1,2-didocosahexaenoyl-sn-glycero-3-phosphoethanolamine,
1,2-dioleoyl-sn-glycero-3-phospho-rac-(1-glycerol) sodium salt (DOPG), sphingomyelin, and any mixtures thereof.

In some embodiments, the delivery agent further comprises a structural lipid.

In some embodiments, the structural lipid is selected from the group consisting of cholesterol, fecosterol, sitosterol, ergosterol, campesterol, stigmasterol, brassicasterol, tomatidine, ursolic acid, alpha-tocopherol, and any mixtures thereof.

In some embodiments, the delivery agent further comprises a PEG lipid.

In some embodiments, the PEG lipid is selected from the group consisting of a PEG-modified phosphatidylethanolamine, a PEG-modified phosphatidic acid, a PEG-modified ceramide, a PEG-modified dialkylamine, a PEG-modified diacylglycerol, a PEG-modified dialkylglycerol, and any mixtures thereof.

In some embodiments, the delivery agent further comprises an ionizable lipid selected from the group consisting of
3-(didodecylamino)-N1,N1,4-tridodecyl-1-piperazineethanamine (KL10),
N1-[2-(didodecylamino)ethyl]-N1,N4,N4-tridodecyl-1,4-piperazinediethanamine (KL22),
14,25-ditridecyl-15,18,21,24-tetraaza-octatriacontane (KL25),
1,2-dilinoleyloxy-N,N-dimethylaminopropane (DLin-DMA),
2,2-dilinoleyl-4-dimethylaminomethyl-[1,3]-dioxolane (DLin-K-DMA),
heptatriaconta-6,9,28,31-tetraen-19-yl 4-(dimethylamino)butanoate (DLin-MC3-DMA),
2,2-dilinoleyl-4-(2-dimethylaminoethyl)-[1,3]-dioxolane (DLin-KC2-DMA),
1,2-dioleyloxy-N,N-dimethylaminopropane (DODMA),
2-({8-[(3β)-cholest-5-en-3-yloxy]octyl}oxy)-N,N-dimethyl-3-[(9Z,12Z)-octadeca-9,12-dien-1-yl oxy]propan-1-amine (Octyl-CLinDMA),
(2R)-2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA (2R)), and
(2S)-2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA (2S)).

In some embodiments, the delivery agent further comprises a phospholipid, a structural lipid, a PEG lipid, or any combination thereof.

In some embodiments, the composition is formulated for in vivo delivery.

In some embodiments, the composition is formulated for intramuscular, subcutaneous, or intradermal delivery.

The present disclosure provides, in certain aspects, a host cell comprising a polynucleotide as described herein.

In some embodiments, the host cell is a eukaryotic cell.

The present disclosure provides, in certain aspects, a vector comprising a polynucleotide as described herein.

The present disclosure provides, in certain aspects, a method of making a polynucleotide comprising enzymatically or chemically synthesizing a polynucleotide as described herein.

The present disclosure provides, in certain aspects, a polypeptide encoded by a polynucleotide as described herein, a composition as described herein, a host cell as described herein, or a vector as described herein or produced by a method a polynucleotide as described herein.

The present disclosure provides, in certain aspects, a method of expressing in vivo an active CFTR polypeptide in a subject in need thereof comprising administering to the subject an effective amount of a polynucleotide as described herein, a composition as described herein, a host cell as described herein, or a vector as described herein.

The present disclosure provides, in certain aspects, a method of treating cystic fibrosis in a subject in need thereof comprising administering to the subject a therapeutically effective amount of a polynucleotide as described herein, a composition as described herein, a host cell as described herein, or a vector as described herein, wherein the administration alleviates the signs or symptoms of cystic fibrosis in the subject.

The present disclosure provides, in certain aspects, a method to prevent or delay the onset of cystic fibrosis signs or symptoms in a subject in need thereof comprising administering to the subject a prophylactically effective amount of a polynucleotide as described herein, a composition as described herein, a host cell as described herein, or a vector as described herein before cystic fibrosis signs or symptoms manifest, wherein the administration prevents or delays the onset of cystic fibrosis signs or symptoms in the subject.

The present disclosure provides, in certain aspects, a method to ameliorate the signs or symptoms of cystic fibrosis in a subject in need thereof comprising administering to the subject a therapeutically effective amount of a polynucleotide as described herein, a composition as described herein, a host cell as described herein, or a vector as described herein before cystic fibrosis or symptoms manifest, wherein the administration ameliorates cystic fibrosis signs or symptoms in the subject.

In some aspects, provided herein is a pharmaceutical composition comprising a lipid nanoparticle encapsulated mRNA that comprises an open reading frame (ORF) encoding a cystic fibrosis transmembrane conductance regulator (CFTR) polypeptide, wherein the composition is suitable for administration, optionally via oral or nasal inhalation, to a human subject in need of treatment for cystic fibrosis.

In other aspects, the disclosure provides a pharmaceutical composition comprising (a) a mRNA that comprises (i) an open reading frame (ORF) encoding a cystic fibrosis transmembrane conductance regulator (CFTR) polypeptide, wherein the ORF comprises at least one chemically modified nucleobase, sugar, backbone, or any combination thereof, (ii) a patterned untranslated region (UTR), and (iii) a microRNA (miRNA) binding site, and (b) a delivery agent, wherein the pharmaceutical composition is suitable for administration, optionally via oral or nasal inhalation, to a human subject in need of treatment for cystic fibrosis.

In yet other aspects, provided herein is a pharmaceutical composition comprising an mRNA comprising an open reading frame (ORF) encoding a cystic fibrosis transmembrane conductance regulator (CFTR) polypeptide, wherein the composition when administered to a subject in need thereof is sufficient to improve a measure of at least one respiratory volume by at least 10%, at least 15%, at least 20%, at least 25%, or at least 30% as compared to a measure of at least one reference respiratory volume in the subject untreated for cystic fibrosis, for at least 24 hours, at least 48 hours, at least 72 hours, at least 96 hours, or at least 120 hours post-administration.

In some embodiments, the at least one respiratory volume is selected from tidal volume, inspiratory reserve volume, expiratory reserve volume, residual volume, vital capacity, and total lung capacity.

Other aspects of the disclosure provide a pharmaceutical composition comprising an mRNA comprising an open reading frame (ORF) encoding a cystic fibrosis transmembrane conductance regulator (CFTR) polypeptide, wherein the composition when administered to a subject in need thereof is sufficient to reduce sweat gland secretion of chloride at least 1-fold, at least 2-fold, at least 3-fold, at least 4-fold, at least 5-fold, or at least 10-fold, as compared to a reference chloride secretion level measured in the subject untreated for cystic fibrosis, for at least 24 hours, at least 48 hours, at least 72 hours, at least 96 hours, or at least 120 hours post-administration.

Still other aspects of the present disclosure provide a pharmaceutical composition comprising an mRNA comprising an open reading frame (ORF) encoding a cystic fibrosis transmembrane conductance regulator (CFTR) polypeptide, wherein the composition when administered to a subject in need thereof is sufficient to increase the pH of airway secretions by a value of at least 0.2 (e.g., 0.2-2), as compared to the pH of airway secretions in the subject untreated for CF, for at least 24 hours, at least 48 hours, at least 72 hours, at least 96 hours, or at least 120 hours post-administration.

Further still, other aspects of the disclosure provide a pharmaceutical composition comprising an mRNA comprising an open reading frame (ORF) encoding a cystic fibrosis transmembrane conductance regulator (CFTR) polypeptide, wherein the composition when administered to a subject in need thereof is sufficient to (i) maintain CFTR activity levels at a normal physiological level or a supraphysiological level for at least 24 hours, at least 48 hours, at least 72 hours, at least 96 hours, or at least 120 hours post-administration, and/or (ii) maintain CFTR activity levels at 50% or more of the normal CFTR activity level for at least 24 hours, at least 48 hours, at least 72 hours, or at least 96 hours post-administration.

Each of the limitations of the invention can encompass various embodiments of the invention. It is, therefore, anticipated that each of the limitations of the invention involving any one element or combinations of elements can be included in each aspect of the invention. This invention is not limited in its application to the details of construction and the arrangement of components set forth in the following description or illustrated in the drawings. The invention is capable of other embodiments and of being practiced or of being carried out in various ways. Also, the phraseology and terminology used herein is for the purpose of description and should not be regarded as limiting. The use of "including," "comprising," or "having," "containing", "involving", and variations thereof herein, is meant to encompass the items listed thereafter and equivalents thereof as well as additional items.

BRIEF DESCRIPTION OF THE DRAWINGS

FIG. 1 shows the protein sequence (panel A), a table with domain features (panel B), and a nucleic acid sequence (panel C) of isoform 1 of CFTR.

FIG. 2 shows the protein sequence of isoform 2 of CFTR.

FIG. 3 shows the protein sequence of isoform 3 of CFTR.

FIG. 5 shows uracil (U) metrics corresponding to wild type isoform 1 of CFTR and 50 sequence optimized CFTR polynucleotides. The column labeled "U content (%)" corresponds to the % $U_{TL}$ parameter. The column labeled "U Content v. WT (%)" corresponds to % $U_{WT}$. The column labeled "U Content v. Theoretical Minimum (%)" corresponds to % $U_{WT}$. The column labeled "UU pairs v. WT (%)" corresponds to % $UU_{WT}$.

FIG. 6 shows guanine (G) metrics corresponding to wild type isoform 1 of CFTR and 50 sequence optimized CFTR polynucleotides. The column labeled "G Content (%)" corresponds to % $G_{TL}$. The column labeled "G Content v. WT (%)" corresponds to % $G_{WT}$. The column labeled "G Content v. Theoretical Maximum (%)" corresponds to % $G_{TMX}$.

FIG. 7 shows cytosine (C) metrics corresponding to wild type isoform 1 of CFTR and 50 sequence optimized CFTR polynucleotides. The column labeled "C Content (%)" corresponds to % $C_{TL}$. The column labeled "C Content v. WT (%)" corresponds to % $C_{WT}$. The column labeled "C Content v. Theoretical Maximum (%)" corresponds to % $C_{TMX}$.

FIG. 8 shows guanine plus cytosine (G/C) metrics corresponding to wild type isoform 1 of CFTR and 50 sequence optimized CFTR polynucleotides. The column labeled "G/C Content (%)" corresponds to % $G/C_{TL}$. The column labeled "G/C Content v. WT (%)" corresponds to % $G/C_{WT}$. The column labeled "G/C Content v. Theoretical Maximum (%)" corresponds to % $G/C_{TMX}$.

FIG. 9 shows a comparison between the G/C compositional bias for codon positions 1, 2, 3 corresponding to the wild type isoform 1 of CFTR and 25 sequence optimized CFTR polynucleotides.

FIG. 10 shows a multiple sequence alignment wild type isoform 1 of CFTR and 50 sequence optimized CFTR polynucleotides. Asterisks below the alignment indicate the location of conserved nucleobases that are identical between the wild type polynucleotide sequence and the sequence optimized CFTR polynucleotides. Non-conserved nucleobases are indicated by spaces and periods below the alignment.

DETAILED DESCRIPTION

Figure 4:
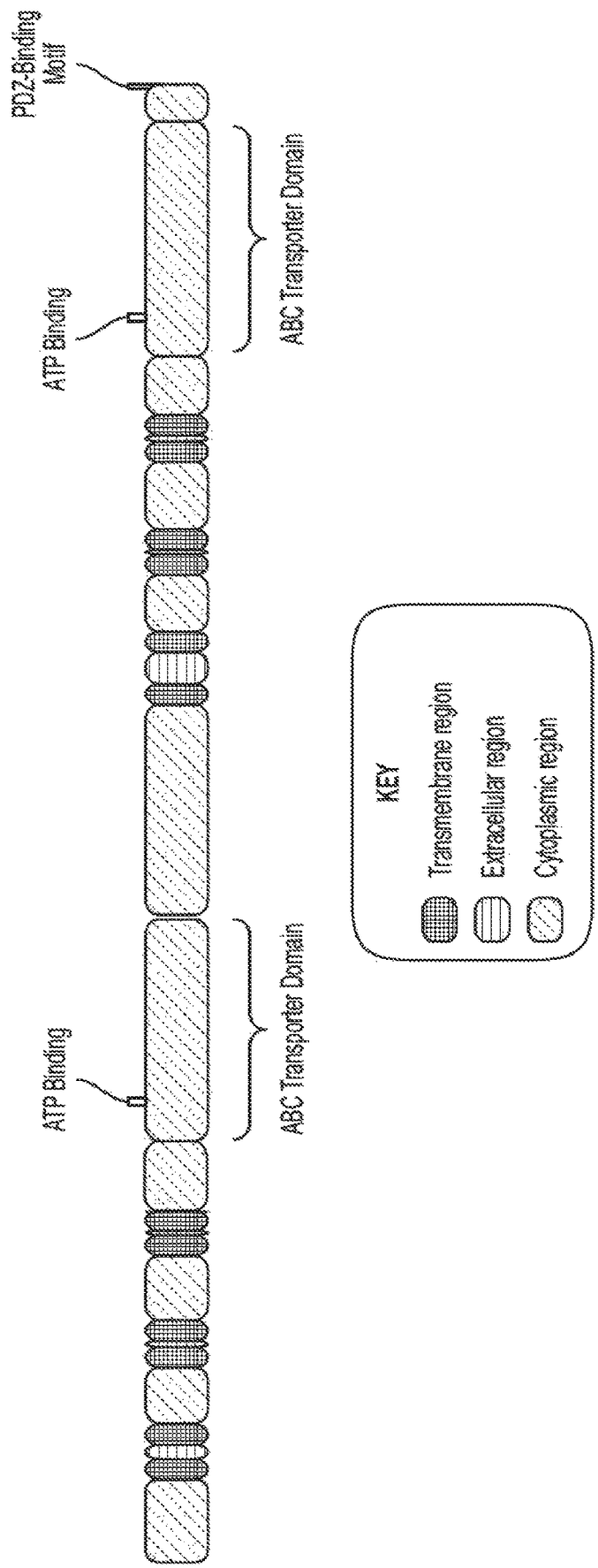
FIG. 4 shows a graphic representation of the CFTR domain structure.

The present disclosure provides mRNA therapeutics for the treatment of cystic fibrosis (CF). Cystic fibrosis (CF) is a progressive, genetic disease that causes persistent lung infections and limits the ability to breathe over time. This disease is characterized by the presence of mutations in both copies of the gene for the cystic fibrosis transmembrane conductance regulator (CFTR) protein. Without CFTR, which is involved in the production of sweat, digestive fluids and mucus, secretions that are usually thin instead become thick. mRNA therapeutics are particularly well-suited for the treatment of CF as the technology provides for the intracellular delivery of mRNA encoding CFTR followed by de novo synthesis of functional CFTR protein within target cells. After delivery of mRNA to the target cells, the desired CFTR protein is expressed by the cells' own translational machinery, and hence, fully functional CFTR protein replaces the defective or missing protein.

One challenge associated with delivering nucleic acid-based therapeutics (e.g., mRNA therapeutics) in vivo stems from the innate immune response that can occur when the body's immune system encounters foreign nucleic acids. Foreign mRNAs can activate the immune system via recognition through toll-like receptors (TLRs), in particular TLR7/8, which is activated by single-stranded RNA (ssRNA). In nonimmune cells, the recognition of foreign mRNA can occur through the retinoic acid-inducible gene I (RIG-I). Immune recognition of foreign mRNAs can result in unwanted cytokine effects including interleukin-1β (IL-1β) production, tumor necrosis factor-α (TNF-α) distribution and a strong type I interferon (type I IFN) response. The present disclosure features the incorporation of different modified nucleotides within therapeutic mRNAs to minimize the immune activation and optimize the translation efficiency of mRNA to protein. Particular embodiments provided herein feature a combination of nucleotide modification to reduce the innate immune response and sequence optimization, in particular, within the open reading frame (ORF) of therapeutic mRNAs encoding CFTR to enhance protein expression.

The mRNA therapeutic technology of the present disclosure also features delivery of mRNA encoding CFTR via a lipid nanoparticle (LNP) delivery system. Lipid nanoparticles (LNPs) are an ideal platform for the safe and effective delivery of mRNAs to target cells. LNPs have the unique ability to deliver nucleic acids by a mechanism involving cellular uptake, intracellular transport and endosomal release or endosomal escape. Some embodiments provided herein feature novel ionizable lipid-based LNPs that have improved properties when administered in vivo. Without being bound in theory, it is believed that the novel ionizable lipid-based LNPs of the present disclosure have improved properties, for example, cellular uptake, intracellular transport and/or endosomal release or endosomal escape. LNPs administered by systemic route (e.g., intravenous (IV) administration), for example, in a first administration, can accelerate the clearance of subsequently injected LNPs, for example, in further administrations. This phenomenon is known as accelerated blood clearance (ABC) and is a key challenge, in particular, when replacing deficient enzymes (e.g., CFTR) in a therapeutic context. This is because repeat administration of mRNA therapeutics is in most instances essential to maintain necessary levels of enzyme in target tissues in subjects (e.g., subjects suffering from CF.) Repeat dosing challenges can be addressed on multiple levels. mRNA engineering and/or efficient delivery by LNPs can result in increased levels and or enhanced duration of protein (e.g., CFTR) being expressed following a first dose of administration, which in turn, can lengthen the time between first dose and subsequent dosing. It is known that the ABC phenomenon is, at least in part, transient in nature, with the immune responses underlying ABC resolving after sufficient time following systemic administration. As such, increasing the duration of protein expression and/or activity following systemic delivery of an mRNA therapeutic of the present disclosure in one aspect, combats the ABC phenomenon. Moreover, LNPs can be engineered to avoid immune sensing and/or recognition and can thus further avoid ABC upon subsequent or repeat dosing. Exemplary aspect of the present disclosure feature novel LNPs which have been engineered to have reduced ABC.

Additionally, the mRNA of the invention may be delivered to pulmonary tissue using oral or nasal inhalation administration methods. Prior art methods for delivering CFTR gene therapy vectors using both viral and non-viral systems, have been developed and tested in the lungs of CF patients (Griesenbach, U. and Alton, E. W. F. W. Adv. Drug Deliv. Rev. 61:128-139 (2009)). However, delivery of these vectors have been plagued with problems. For instance the development of humoral immunity is a problem for adenoviral vectors. The LNP formulations of the invention provide advantages for pulmonary delivery of nucleic acids such as the mRNA encoding CFTR, enabling effective levels of CFTR expression while avoiding eliciting dangerous immune responses.

1. Cystic Fibrosis Transmembrane Conductance Regulator (CFTR)

Cystic Fibrosis Transmembrane Conductance Regulator (CFTR; EC 3.6.3.49) is an ABC transporter-class ion channel. It conducts chloride and thiocyanate ions across epithelial cell membranes. The structure of the approximately 168 kDa CFTR, which is highly conserved amongst organisms, consists of seven domains. CFTR contains two transmembrane domains with six transmembrane helices each. Additionally, CFTR contains two nucleotide binding domains, two ABC transporter domains, and one PDZ-binding domain. The nucleotide binding domains are used for binding and hydrolyzing ATP, ABC transporters move ions across the plasma membrane, and the PDZ-binding domain which CFTR to anchor itself to the plasma membrane. CFTR usually exists in dimer units in the plasma membrane of the cell.

The most well-known health issue involving CFTR is cystic fibrosis (CF), an autosomal recessive genetic disorder where non-functional CFTR prevents excretion of chloride ions and leads to increased sodium ion absorption, leading to more viscous mucus. This is caused by gene mutations that, in most cases, produce non-functional CFTR.

The coding sequence (CDS) for wild type CFTR canonical mRNA sequence is described at the NCBI Reference Sequence database (RefSeq) under accession number NM_000492.3 ("Homo sapiens cystic fibrosis transmembrane conductance regulator (ATP-binding cassette subfamily C, member 7) (CFTR), mRNAmRNA"). The wild type CFTR canonical protein sequence, corresponding to isoform 1, is described at the RefSeq database under accession number NP_000483.3 ("Cystic fibrosis transmembrane conductance regulator [ Homo sapiens]"). The CFTR isoform 1 protein is 1480 amino acids long. It is noted that the specific nucleic acid sequences encoding the reference protein sequence in the Ref Seq sequences are the coding sequence (CDS) as indicated in the respective RefSeq database entry.

Isoforms 2 and 3 are produced by alternative splicing.

Isoforms 2 and 3 of CFTR are encoded by the CDS disclosed in the above mentioned mRNA RefSeq entry.

The isoform 2 polynucleotide is created by exon skipping because of a large number of TG repeats and a low number of T repeats at the intron-exon boundry. It encodes a CFTR isoform 2 polypeptide, which is 1419 amino acids long and lacks amino acids 404-464 of isoform 1. This isoform protein causes congenital bilateral absence of the vas deferens (CBAVD).

The isoform 3 polynucleotide is created by a mutation in exonic splicing enhancer (ESE) that has an alternative acceptor site. The resulting CFTR isoform 3 polypeptide is 605 amino acids long, has a different sequence for amino acids 589-605 than isoform 1, and lacks amino acids 606-1480 from isoform 1.

In certain aspects, the present disclosure provides a polynucleotide (e.g., a ribonucleic acid (RNA), e.g., a messenger RNA (mRNA)) comprising a nucleotide sequence (e.g., an open reading frame (ORF)) encoding a CFTR polypeptide. In some embodiments, the CFTR polypeptide of the present disclosure is a wild type CFTR isoform 1, 2, or 3 protein. In some embodiments, the CFTR polypeptide of the present disclosure is a variant, a peptide or a polypeptide containing a substitution, and insertion and/or an addition, a deletion and/or a covalent modification with respect to a wild-type CFTR isoform 1, 2, or 3 sequence. In some embodiments, sequence tags or amino acids, can be added to the sequences encoded by the polynucleotides of the present disclosure (e.g., at the N-terminal or C-terminal ends), e.g., for localization. In some embodiments, amino acid residues located at the carboxy, amino terminal, or internal regions of a polypeptide of the present disclosure can optionally be deleted providing for fragments.

In some embodiments, the polynucleotide (e.g., a RNA, e.g., an mRNA) comprising a nucleotide sequence (e.g., an ORF) of the present disclosure encodes a substitutional variant of a CFTR isoform 1, 2, or 3 sequence, which can comprise one, two, three or more than three substitutions. In some embodiments, the substitutional variant can comprise one or more conservative amino acids substitutions. In other embodiments, the variant is an insertional variant. In other embodiments, the variant is a deletional variant.

As recognized by those skilled in the art, CFTR isoform 1, 2, or 3 protein fragments, functional protein domains, variants, and homologous proteins (orthologs) are also considered to be within the scope of the CFTR polypeptides of the present disclosure. Nonlimiting examples of polypeptides encoded by the polynucleotides of the present disclosure are shown in FIGS. 1 to 3. For example, FIG. 1 shows the amino acid sequence of human CFTR wild type isoform 1.

Certain compositions and methods presented in this disclosure refer to the protein or polynucleotide sequences of CFTR isoform 1. A person skilled in the art will understand that such disclosures are equally applicable to any other isoforms of CFTR known in the art.

2. Polynucleotides and Open Reading Frames (ORFs)

In certain aspects, the present disclosure provides polynucleotides (e.g., a RNA, e.g., an mRNA) that comprise a nucleotide sequence (e.g., an ORF) encoding one or more CFTR polypeptides. In some embodiments, the encoded CFTR polypeptide of the present disclosure can be selected from:
  (i) a full length CFTR polypeptide (e.g., having the same or essentially the same length as wild-type CFTR isoform 1, 2, or 3);
  (ii) a functional fragment of any of the CFTR isoforms described herein (e.g., a truncated (e.g., deletion of carboxy, amino terminal, or internal regions) sequence shorter than one of wild-type isoforms 1, 2, or 3; but still retaining CFTR enzymatic activity);
  (iii) a variant thereof (e.g., full length or truncated isoform 1, 2, or 3 proteins in which one or more amino acids have been replaced, e.g., variants that retain all or most of the CFTR activity of the polypeptide with respect to a reference isoform (such as, e.g., T59I, D178N, or any other natural or artificial variants known in the art); or
  (iv) a fusion protein comprising (i) a full length CFTR isoform 1, 2, or 3 protein, a functional fragment or a variant thereof, and (ii) a heterologous protein.

In certain embodiments, the encoded CFTR polypeptide is a mammalian CFTR polypeptide, such as a human CFTR polypeptide, a functional fragment or a variant thereof.

In some embodiments, the polynucleotide (e.g., a RNA, e.g., an mRNA) of the present disclosure increases CFTR protein expression levels and/or detectable CFTR enzymatic activity levels in cells when introduced in those cells, e.g., by at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100%, compared to CFTR protein expression levels and/or detectable CFTR enzymatic activity levels in the cells prior to the administration of the polynucleotide of the present disclosure. CFTR protein expression levels and/or CFTR enzymatic activity can be measured according to methods know in the art. In some embodiments, the polynucleotide is introduced to the cells in vitro. In some embodiments, the polynucleotide is introduced to the cells in vivo.

In some embodiments, the polynucleotides (e.g., a RNA, e.g., an mRNA) of the present disclosure comprise a nucleotide sequence (e.g., an ORF) that encodes a wild-type human CFTR, e.g., wild-type isoform 1 of human CFTR (SEQ ID NO: 1, see FIG. 1), wild-type isoform 2 of human CFTR (SEQ ID NO: 3, see FIG. 2), or wild-type isoform 3 of human CFTR (SEQ ID NO: 4, see FIG. 3).

In some embodiments, the polynucleotide (e.g., a RNA, e.g., an mRNA) of the present disclosure comprises a codon optimized nucleic acid sequence, wherein the open reading frame (ORF) of the codon optimized nucleic sequence is derived from a wild-type CFTR sequence (e.g., wild-type isoforms 1, 2, or 3). For example, for polynucleotides of present disclosure comprising a sequence optimized ORF encoding CFTR isoform 2, the corresponding wild type sequence is the native CFTR isoform 2. Similarly, for an sequence optimized mRNA encoding a functional fragment of isoform 1, the corresponding wild type sequence is the corresponding fragment from CFTR isoform 1.

In some embodiments, the polynucleotides (e.g., a RNA, e.g., an mRNA) of the present disclosure comprise a nucleotide sequence encoding CFTR isoform 1 having the full length sequence of human CFTR isoform 1 (i.e., including the initiator methionine). In mature human CFTR isoform 1, the initiator methionine can be removed to yield a "mature CFTR" comprising amino acid residues of 2-1480 of the translated product. The teachings of the present disclosure directed to the full sequence of human CFTR (amino acids 1-1480) are also applicable to the mature form of human CFTR lacking the initiator methionine (amino acids 2-1480). Thus, in some embodiments, the polynucleotides (e.g., a RNA, e.g., an mRNA) of the present disclosure comprise a nucleotide sequence encoding CFTR isoform 1 having the mature sequence of human CFTR isoform 1 (i.e., lacking the initiator methionine). In some embodiments, the polynucleotide (e.g., a RNA, e.g., an mRNA) of the present disclosure comprising a nucleotide sequence encoding CFTR isoform 1 having the full length or mature sequence of human CFTR isoform 1 is sequence optimized.

In some embodiments, the polynucleotides (e.g., a RNA, e.g., an mRNA) of the present disclosure comprise a nucleotide sequence (e.g., an ORF) encoding a mutant CFTR polypeptide. In some embodiments, the polynucleotides of the present disclosure comprise an ORF encoding a CFTR polypeptide that comprises at least one point mutation in the CFTR sequence and retains CFTR enzymatic activity. In some embodiments, the mutant CFTR polypeptide has a CFTR activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% of the CFTR activity of the corresponding wild-type CFTR (i.e., the same CFTR isoform but without the mutation(s)). In some embodiments, the polynucleotide (e.g., a RNA, e.g., an mRNA) of the present disclosure comprising an ORF encoding a mutant CFTR polypeptide is sequence optimized.

In some embodiments, the polynucleotide (e.g., a RNA, e.g., an mRNA) of the present disclosure comprises a nucleotide sequence (e.g., an ORF) that encodes a CFTR polypeptide with mutations that do not alter CFTR enzymatic activity. Such mutant CFTR polypeptides can be referred to as function-neutral. In some embodiments, the polynucleotide comprises an ORF that encodes a mutant CFTR polypeptide comprising one or more function-neutral point mutations.

In some embodiments, the mutant CFTR polypeptide has higher CFTR enzymatic activity than the corresponding wild-type CFTR. In some embodiments, the mutant CFTR polypeptide has a CFTR activity that is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% higher than the activity of the corresponding wild-type CFTR (i.e., the same CFTR isoform but without the mutation(s)).

In some embodiments, the polynucleotides (e.g., a RNA, e.g., an mRNA) of the present disclosure comprise a nucleotide sequence (e.g., an ORF) encoding a functional CFTR fragment, e.g., where one or more fragments correspond to a polypeptide subsequence of a wild type CFTR polypeptide and retain CFTR enzymatic activity. In some embodiments, the CFTR fragment has a CFTR activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% of the CFTR activity of the corresponding full length CFTR. In some embodiments, the polynucleotides (e.g., a RNA, e.g., an mRNA) of the present disclosure comprising an ORF encoding a functional CFTR fragment is sequence optimized.

In some embodiments, the polynucleotide (e.g., a RNA, e.g., an mRNA) of the present disclosure comprises a nucleotide sequence (e.g., an ORF) encoding a CFTR fragment that has higher CFTR enzymatic activity than the corresponding full length CFTR. Thus, in some embodiments the CFTR fragment has a CFTR activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% higher than the CFTR activity of the corresponding full length CFTR.

In some embodiments, the polynucleotide (e.g., a RNA, e.g., an mRNA) of the present disclosure comprises a nucleotide sequence (e.g., an ORF) encoding a CFTR fragment that is at least 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24% or 25% shorter than wild-type isoform 1, 2, or 3 of CFTR.

In some embodiments, the polynucleotide (e.g., a RNA, e.g., an mRNA) of the present disclosure comprises a nucleotide sequence (e.g., an ORF) encoding a CFTR polypeptide (e.g., the wild-type sequence, functional fragment, or variant thereof), wherein the nucleotide sequence is at least 70%, at least 75%, at least 80%, at least 85%, at least 90%, at least 95%, at least 96%, at least 97%, at least 98%, at least 99%, or 100% identical to the sequence of SEQ ID NO:2 (see, FIG. 1).

In some embodiments, the polynucleotide (e.g., a RNA, e.g., an mRNA) of the present disclosure comprises a nucleotide sequence (e.g., an ORF) encoding a CFTR polypeptide (e.g., the wild-type sequence, functional fragment, or variant thereof), wherein the nucleotide sequence has at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 5 to 54. See TABLE 2; FIG. 10.

In some embodiments, the polynucleotide (e.g., a RNA, e.g., an mRNA) of the present disclosure comprises a nucleotide sequence (e.g., an ORF) encoding a CFTR polypeptide (e.g., the wild-type sequence, functional fragment, or variant thereof), wherein the nucleotide sequence has 70% to 100%, 75% to 100%, 80% to 100%, 85% to 100%, 70% to 95%, 80% to 95%, 70% to 85%, 75% to 90%, 80% to 95%, 70% to 75%, 75% to 80%, 80% to 85%, 85% to 90%, 90% to 95%, or 95% to 100%, sequence identity to a sequence selected from the group consisting of SEQ ID NOs: 5 to 54. See TABLE 2; FIG. 10.

In some embodiments, the polynucleotide (e.g., a RNA, e.g., an mRNA) of the present disclosure comprises a nucleotide sequence (e.g., an ORF) encoding a CFTR polypeptide (e.g., the wild-type sequence, functional fragment, or variant thereof), wherein the nucleotide sequence is at least 73%, at least 74%, at least 75%, at least 76%, at least 77%, at least 78%, at least 79%, least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the sequence of SEQ ID NO:2 (see, FIG. 1).

In some embodiments the polynucleotide (e.g., a RNA, e.g., an mRNA) of the present disclosure comprises a nucleotide sequence (e.g., an ORF) encoding a CFTR polypeptide (e.g., the wild-type sequence, functional fragment, or variant thereof), wherein the nucleotide sequence is between 73% and 90% identical; between 73% and 85% identical; between 73% and 79% identical; between 77% and 83% identical, between 71% and 77% identical, or between 73% and 75% identical to the sequence of SEQ ID NO:2 (see, FIG. 1).

In some embodiments, the polynucleotide (e.g., a RNA, e.g., an mRNA) of the present disclosure comprises from about 3500 to about 100,000 nucleotides (e.g., from 3,500 to 5,000, from 3,500 to 5,100, from 3,500 to 5,200, from 3,500 to 5,300, from 3,500 to 5,400, from 3,500 to 5,500, from 3,600 to 5,100, from 3,600 to 5,100, from 3,600 to 5,200, from 3,600 to 5,300, from 3,600 to 5,400, from 3,600 to 5,500, from 4,440 to 5,200, from 4,440 to 5,400, from 4,440 to 5,600, from 4,440 to 5,800, from 4,440 to 6,000, from 4,440 to 7,000, from 4,440 to 8,000, from 4,440 to 10,000, from 4,440 to 12,000, from 4,440 to 25,000, from 4,440 to 50,000, from 4,440 to 70,000, or from 4,440 to 100,000).

In some embodiments, the polynucleotide of the present disclosure (e.g., a RNA, e.g., an mRNA) comprises a nucleotide sequence (e.g., an ORF) encoding a CFTR polypeptide (e.g., the wild-type sequence, functional fragment, or variant thereof), wherein the length of the nucleotide sequence (e.g., an ORF) is at least 500 nucleotides in length (e.g., at least or greater than about 500, 600, 700, 80, 900, 1,000, 1,050, 1,083, 1,100, 1,200, 1,300, 1,400, 1,500, 1,600, 1,700, 1,800, 1,900, 2,000, 2,100, 2,200, 2,300, 2,400, 2,500, 2,600, 2,700, 2,800, 2,900, 3,000, 3,100, 3,200, 3,300, 3,400, 3,500, 3,600, 3,700, 3,800, 3,900, 4,000, 4,100, 4,200, 4,300, 4,400, 4,440 4,500, 4,600, 4,700, 4,800, 4,900, 5,000, 5,100, 5,200, 5,300, 5,400, 5,500, 5,600, 5,700, 5,800, 5,900, 6,000, 7,000, 8,000, 9,000, 10,000, 20,000, 30,000, 40,000, 50,000, 60,000, 70,000, 80,000, 90,000 or up to and including 100,000 nucleotides).

In some embodiments, the polynucleotide of the present disclosure (e.g., a RNA, e.g., an mRNA) comprises a nucleotide sequence (e.g., an ORF) encoding a CFTR polypeptide (e.g., the wild-type sequence, functional fragment, or variant thereof) further comprises at least one nucleic acid sequence that is noncoding, e.g., a miRNA binding site.

In some embodiments, the polynucleotide of the present disclosure (e.g., a RNA, e.g., an mRNA) comprises a nucleotide sequence (e.g., an ORF) encoding a CFTR polypeptide is single stranded or double stranded.

In some embodiments, the polynucleotide of the present disclosure comprising a nucleotide sequence (e.g., an ORF) encoding a CFTR polypeptide (e.g., the wild-type sequence, functional fragment, or variant thereof) is DNA or RNA. In some embodiments, the polynucleotide of the present disclosure is RNA. In some embodiments, the polynucleotide of the present disclosure is, or functions as, a messenger RNA (mRNA). In some embodiments, the mRNA comprises a nucleotide sequence (e.g., an ORF) that encodes at least one CFTR polypeptide, and is capable of being translated to produce the encoded CFTR polypeptide in vitro, in vivo, in situ or ex vivo.

In some embodiments, the polynucleotide of the present disclosure (e.g., a RNA, e.g., an mRNA) comprises a sequence-optimized nucleotide sequence (e.g., an ORF) encoding a CFTR polypeptide (e.g., the wild-type sequence, functional fragment, or variant thereof), wherein the polynucleotide comprises at least one chemically modified nucleobase, e.g., 5-methoxyuracil. In some embodiments, the polynucleotide further comprises a miRNA binding site, e.g., a miRNA binding site that binds to miR-142. In some embodiments, the polynucleotide disclosed herein is formulated with a delivery agent, e.g., a compound having Formula (I), (IA), (II), (IIa), (IIb), (IIc), (IId) or (IIe), e.g., any of Compounds 1-232, e.g., any of Compounds 1-232.

3. Signal Sequences

The polynucleotides (e.g., a RNA, e.g., an mRNA) of the present disclosure can also comprise nucleotide sequences that encode additional features that facilitate trafficking of the encoded polypeptides to therapeutically relevant sites. One such feature that aids in protein trafficking is the signal sequence, or targeting sequence. The peptides encoded by these signal sequences are known by a variety of names, including targeting peptides, transit peptides, and signal peptides. In some embodiments, the polynucleotide (e.g., a RNA, e.g., an mRNA) comprises a nucleotide sequence (e.g., an ORF) that encodes a signal peptide operably linked a nucleotide sequence that encodes a CFTR polypeptide described herein.

In some embodiments, the "signal sequence" or "signal peptide" is a polynucleotide or polypeptide, respectively, which is from about 9 to 200 nucleotides (3-70 amino acids) in length that, optionally, is incorporated at the 5' (or N-terminus) of the coding region or the polypeptide, respectively. Addition of these sequences results in trafficking the encoded polypeptide to a desired site, such as the endoplasmic reticulum or the mitochondria through one or more targeting pathways. Some signal peptides are cleaved from the protein, for example by a signal peptidase after the proteins are transported to the desired site.

In some embodiments, the polynucleotide of the present disclosure comprises a nucleotide sequence encoding a CFTR polypeptide, wherein the nucleotide sequence further comprises a 5' nucleic acid sequence encoding a heterologous signal peptide.

4. Fusion Proteins

In some embodiments, the polynucleotide of the present disclosure (e.g., a RNA, e.g., an mRNA) can comprise more than one nucleic acid sequence (e.g., an ORF) encoding a polypeptide of interest. In some embodiments, polynucleotides of the present disclosure comprise a single ORF encoding a CFTR polypeptide, a functional fragment, or a variant thereof. However, in some embodiments, the polynucleotide of the present disclosure can comprise more than one ORF, for example, a first ORF encoding a CFTR polypeptide (a first polypeptide of interest), a functional fragment, or a variant thereof, and a second ORF expressing a second polypeptide of interest. In some embodiments, two or more polypeptides of interest can be genetically fused, i.e., two or more polypeptides can be encoded by the same ORF. In some embodiments, the polynucleotide can comprise a nucleic acid sequence encoding a linker (e.g., a $G_4S$ peptide linker or another linker known in the art) between two or more polypeptides of interest.

In some embodiments, a polynucleotide of the present disclosure (e.g., a RNA, e.g., an mRNA) can comprise two, three, four, or more ORFs, each expressing a polypeptide of interest.

In some embodiments, the polynucleotide of the present disclosure (e.g., a RNA, e.g., an mRNA) can comprise a first nucleic acid sequence (e.g., a first ORF) encoding a CFTR polypeptide and a second nucleic acid sequence (e.g., a second ORF) encoding a second polypeptide of interest.

5. Sequence Optimization of Nucleotide Sequence Encoding a CFTR Polypeptide

In some embodiments, the polynucleotide (e.g., a RNA, e.g., an mRNA) of the present disclosure is sequence optimized. In some embodiments, the polynucleotide (e.g., a RNA, e.g., an mRNA) of the present disclosure comprises a nucleotide sequence (e.g., an ORF) encoding a CFTR polypeptide, a nucleotide sequence (e.g, an ORF) encoding another polypeptide of interest, a 5'-UTR, a 3'-UTR, a miRNA, a nucleotide sequence encoding a linker, or any combination thereof) that is sequence optimized.

A sequence-optimized nucleotide sequence, e.g., an codon-optimized mRNA sequence encoding a CFTR polypeptide, is a sequence comprising at least one synonymous nucleobase substitution with respect to a reference sequence (e.g., a wild type nucleotide sequence encoding a CFTR polypeptide).

A sequence-optimized nucleotide sequence can be partially or completely different in sequence from the reference sequence. For example, a reference sequence encoding polyserine uniformly encoded by TCT codons can be sequence-optimized by having 100% of its nucleobases substituted (for each codon, T in position 1 replaced by A, C in position 2 replaced by G, and T in position 3 replaced by C) to yield a sequence encoding polyserine which would be uniformly encoded by AGC codons. The percentage of sequence identity obtained from a global pairwise alignment between the reference polyserine nucleic acid sequence and the sequence-optimized polyserine nucleic acid sequence would be 0%. However, the protein products from both sequences would be 100% identical.

Some sequence optimization (also sometimes referred to codon optimization) methods are known in the art (and discussed in more detail below) and can be useful to achieve one or more desired results. These results can include, e.g., matching codon frequencies in certain tissue targets and/or host organisms to ensure proper folding; biasing G/C content to increase mRNA stability or reduce secondary structures; minimizing tandem repeat codons or base runs that can impair gene construction or expression; customizing transcriptional and translational control regions; inserting or removing protein trafficking sequences; removing/adding post translation modification sites in an encoded protein (e.g., glycosylation sites); adding, removing or shuffling protein domains; inserting or deleting restriction sites; modifying ribosome binding sites and mRNA degradation sites; adjusting translational rates to allow the various domains of the protein to fold properly; and/or reducing or eliminating problem secondary structures within the polynucleotide. Sequence optimization tools, algorithms and services are known in the art, non-limiting examples include services from GeneArt (Life Technologies), DNA2.0 (Menlo Park CA) and/or proprietary methods.

Codon options for each amino acid are given in TABLE 1.

TABLE 1

Codon Options

| Amino Acid | Single Letter Code | Codon Options |
|---|---|---|
| Isoleucine | I | ATT, ATC, ATA |
| Leucine | L | CTT, CTC, CTA, CTG, TTA, TTG |
| Valine | V | GTT, GTC, GTA, GTG |
| Phenylalanine | F | TTT, TTC |
| Methionine | M | ATG |
| Cysteine | C | TGT, TGC |
| Alanine | A | GCT, GCC, GCA, GCG |
| Glycine | G | GGT, GGC, GGA, GGG |
| Proline | P | CCT, CCC, CCA, CCG |
| Threonine | T | ACT, ACC, ACA, ACG |
| Serine | S | TCT, TCC, TCA, TCG, AGT, AGC |
| Tyrosine | Y | TAT, TAC |
| Tryptophan | W | TGG |
| Glutamine | Q | CAA, CAG |
| Asparagine | N | AAT, AAC |
| Histidine | H | CAT, CAC |
| Glutamic acid | E | GAA, GAG |
| Aspartic acid | D | GAT, GAC |
| Lysine | K | AAA, AAG |
| Arginine | R | CGT, CGC, CGA, CGG, AGA, AGG |
| Selenocysteine | Sec | UGA in mRNA in presence of Selenocysteine insertion element (SECTS) |
| Stop codons | Stop | TAA, TAG, TGA |

In some embodiments, a polynucleotide (e.g., a RNA, e.g., an mRNA) of the present disclosure comprises a sequence-optimized nucleotide sequence (e.g., an ORF) encoding a CFTR polypeptide, a functional fragment, or a variant thereof, wherein the CFTR polypeptide, functional fragment, or a variant thereof encoded by the sequence-optimized nucleotide sequence has improved properties (e.g., compared to a CFTR polypeptide, functional fragment, or a variant thereof encoded by a reference nucleotide sequence that is not sequence optimized), e.g., improved properties related to expression efficacy after administration in vivo. Such properties include, but are not limited to, improving nucleic acid stability (e.g., mRNA stability), increasing translation efficacy in the target tissue, reducing the number of truncated proteins expressed, improving the folding or prevent misfolding of the expressed proteins, reducing toxicity of the expressed products, reducing cell death caused by the expressed products, increasing and/or decreasing protein aggregation.

In some embodiemtns, the sequence-optimized nucleotide sequence is codon optimized for expression in human subjects, having structural and/or chemical features that avoid one or more of the problems in the art, for example, features which are useful for optimizing formulation and delivery of nucleic acid-based therapeutics while retaining structural and functional integrity; overcoming a threshold of expression; improving expression rates; half-life and/or protein concentrations; optimizing protein localization; and avoiding deleterious bio-responses such as the immune response and/or degradation pathways.

In some embodiments, the polynucleotides of the present disclosure comprise a nucleotide sequence (e.g., a nucleotide sequence (e.g., an ORF) encoding a CFTR polypeptide, a nucleotide sequence (e.g., an ORF) encoding another polypeptide of interest, a 5'-UTR, a 3'-UTR, a microRNA, a nucleic acid sequence encoding a linker, or any combination thereof) that is sequence-optimized according to a method comprising:

(i) substituting at least one codon in a reference nucleotide sequence (e.g., an ORF encoding a CFTR polypeptide) with an alternative codon to increase or decrease uridine content to generate a uridine-modified sequence;

(ii) substituting at least one codon in a reference nucleotide sequence (e.g., an ORF encoding a CFTR polypeptide) with an alternative codon having a higher codon frequency in the synonymous codon set;

(iii) substituting at least one codon in a reference nucleotide sequence (e.g., an ORF encoding a CFTR polypeptide) with an alternative codon to increase G/C content; or (iv) a combination thereof.

In some embodiments, the sequence-optimized nucleotide sequence (e.g., an ORF encoding a CFTR polypeptide) has at least one improved property with respect to the reference nucleotide sequence.

In some embodiments, the sequence optimization method is multiparametric and comprises one, two, three, four, or more methods disclosed herein and/or other optimization methods known in the art.

Features, which can be considered beneficial in some embodiments of the present disclosure, can be encoded by or within regions of the polynucleotide and such regions can be upstream (5') to, downstream (3') to, or within the region that encodes the CFTR polypeptide. These regions can be incorporated into the polynucleotide before and/or after sequence-optimization of the protein encoding region or open reading frame (ORF). Examples of such features include, but are not limited to, untranslated regions (UTRs), microRNA sequences, Kozak sequences, oligo(dT) sequences, poly-A tail, and detectable tags and can include multiple cloning sites that can have XbaI recognition.

In some embodiments, the polynucleotide of the present disclosure comprises a 5' UTR. a 3' UTR and/or a miRNA binding site. In some embodiments, the polynucleotide comprises two or more 5' UTRs and/or 3' UTRs, which can be the same or different sequences. In some embodiments, the polynucleotide comprises two or more miRNA binding site, which can be the same or different sequences. Any portion of the 5' UTR, 3' UTR, and/or miRNA binding site, including none, can be sequence-optimized and can independently contain one or more different structural or chemical modifications, before and/or after sequence optimization.

In some embodiments, after optimization, the polynucleotide is reconstituted and transformed into a vector such as, but not limited to, plasmids, viruses, cosmids, and artificial chromosomes. For example, the optimized polynucleotide can be reconstituted and transformed into chemically competent E. coli, yeast, neurospora, maize, drosophila, etc. where high copy plasmid-like or chromosome structures occur by methods described herein.

6. Sequence-Optimized Nucleotide Sequences Encoding CFTR Polypeptides

In some embodiments, the polynucleotide of the present disclosure comprises a sequence-optimized nucleotide sequence encoding a CFTR polypeptide disclosed herein. In some embodiments, the polynucleotide of the present disclosure comprises an open reading frame (ORF) encoding a CFTR polypeptide, wherein the ORF has been sequence optimized.

Exemplary sequence-optimized nucleotide sequences encoding human CFTR isoform 1 are shown in TABLE 2. In some embodiments, the sequence optimized CFTR sequences in TABLE 2, fragments, and variants thereof are used to practice the methods disclosed herein. In some embodiments, the sequence optimized CFTR sequences in TABLE 2, fragments and variants thereof are combined with or alternatives to the wild-type sequences disclosed in FIGS. 1-3.

---

Lengthy table referenced here

US11801227-20231031-T00001

Please refer to the end of the specification for access instructions.

---

The sequence-optimized nucleotide sequences disclosed herein are distinct from the corresponding wild type nucleotide acid sequences and from other known sequence-optimized nucleotide sequences, e.g., these sequence-optimized nucleic acids have unique compositional characteristics.

In some embodiments, the percentage of uracil or thymine nucleobases in a sequence-optimized nucleotide sequence (e.g., encoding a CFTR polypeptide, a functional fragment, or a variant thereof) is modified (e.g., reduced) with respect to the percentage of uracil or thymine nucleobases in the reference wild-type nucleotide sequence. Such a sequence is referred to as a uracil-modified or thymine-modified sequence. The percentage of uracil or thymine content in a nucleotide sequence can be determined by dividing the number of uracils or thymines in a sequence by the total number of nucleotides and multiplying by 100. In some embodiments, the sequence-optimized nucleotide sequence has a lower uracil or thymine content than the uracil or thymine content in the reference wild-type sequence. In some embodiments, the uracil or thymine content in a sequence-optimized nucleotide sequence of the present disclosure is greater than the uracil or thymine content in the reference wild-type sequence and still maintain beneficial effects, e.g., increased expression and/or reduced Toll-Like Receptor (TLR) response when compared to the reference wild-type sequence.

The uracil or thymine content of wild-type CFTR isoform 1 is about 27.82%. In some embodiments, the uracil or thymine content of a uracil- or thymine-modified sequence encoding a CFTR polypeptide is less than 27.82%. In some embodiments, the uracil or thymine content of a uracil- or thymine-modified sequence encoding a CFTR polypeptide of the present disclosure is less than 19%, less that 18%, less than 17%, less than 16%, less than 15%, less than 14%, less than 13%, less than 12%, less than 11%, or less than 10%. In some embodiments, the uracil or thymine content is not less than 18%, 17%, 16%, 15%, 14%, 13%, 12%, 11%, or 10%. The uracil or thymine content of a sequence disclosed herein, i.e., its total uracil or thymine content is abbreviated herein as % $U_{TL}$ or % $T_{TL}$.

In some embodiments, the uracil or thymine content (% $U_{TL}$ or % $T_{TL}$) of a uracil- or thymine-modified sequence encoding a CFTR polypeptide of the present disclosure is between 12% and 25%, between 12% and 24%, between 13% and 24%, between 13% and 23%, between 14% and 23%, between 14% and 22%, between 15% and 22%, between 15% and 21%, between 16% and 21%, between 16% and 20%, between 175% and 20%, or between 17% and 19%.

In some embodiments, the uracil or thymine content (% $U_{TL}$, or % $T_{TL}$) of a uracil- or thymine-modified sequence encoding a CFTR polypeptide of the present disclosure is between 16% and 20%, between 17% and 20%, or, or between 17% and 19%.

In a particular embodiment, the uracil or thymine content (% $U_{TL}$, or % $T_{TL}$) of a uracil- or thymine modified sequence encoding a CFTR polypeptide of the present disclosure is between about 17% and about 19%, e.g., between 18% and 19%.

A uracil- or thymine-modified sequence encoding a CFTR polypeptide of the present disclosure can also be described according to its uracil or thymine content relative to the uracil or thymine content in the corresponding wild-type nucleic acid sequence (% $U_{WT}$ or % $T_{WT}$), or according to its uracil or thymine content relative to the theoretical minimum uracil or thymine content of a nucleic acid encoding the wild-type protein sequence (% $U_{TM}$ or (% $T_{TM}$).

The phrases "uracil or thymine content relative to the uracil or thymine content in the wild type nucleic acid sequence," refers to a parameter determined by dividing the number of uracils or thymines in a sequence-optimized nucleic acid by the total number of uracils or thymines in the corresponding wild-type nucleic acid sequence and multiplying by 100. This parameter is abbreviated herein as % $U_{WT}$ or % $T_{WT}$.

In some embodiments, the % $U_{WT}$ or % $T_{WT}$ of a uracil- or thymine-modified sequence encoding a CFTR polypeptide of the present disclosure is above 50%, above 55%, above 60%, above 65%, above 70%, above 75%, above 80%, above 85%, above 90%, or above 95%.

In some embodiments, the % $U_{WT}$ or % $T_{WT}$ of a uracil- or thymine modified sequence encoding a CFTR polypeptide of the present disclosure is between 54% and 77%, between 55% and 76%, between 56% and 75%, between 57% and 74%, between 58% and 73%, between 59% and 72%, between 60% and 71%, between 61% and 70%, between 62% and 69%, between 63% and 68%, or between 64% and 68%.

In some embodiments, the % $U_{WT}$ or % $T_{WT}$ of a uracil- or thymine-modified sequence encoding a CFTR polypeptide of the present disclosure is between 62% and 70%, between 63% and 69%, or between 64% and 68%.

In a particular embodiment, the % $U_{WT}$ or % $T_{WT}$ of a uracil- or thymine-modified sequence encoding a CFTR polypeptide of the present disclosure is between about 64% and about 68%, e.g., between 64% and 67%.

Uracil- or thymine-content relative to the uracil or thymine theoretical minimum, refers to a parameter determined by dividing the number of uracils or thymines in a sequence-optimized nucleotide sequence by the total number of uracils or thymines in a hypothetical nucleotide sequence in which all the codons in the hypothetical sequence are replaced with synonymous codons having the lowest possible uracil or thymine content and multiplying by 100. This parameter is abbreviated herein as % $U_{TM}$ or % $T_{TM}$.

For DNA it is recognized that thymine is present instead of uracil, and one would substitute T where U appears. Thus, all the disclosures related to, e.g., % $U_{TM}$, % $U_{WT}$, or % $U_{TL}$, with respect to RNA are equally applicable to % $T_{TM}$, % $T_{WT}$, or % $T_{TL}$ with respect to DNA.

In some embodiments, the % $U_{TM}$ of a uracil-modified sequence encoding a CFTR polypeptide of the present disclosure is below 300%, below 295%, below 290%, below 285%, below 280%, below 275%, below 270%, below 265%, below 260%, below 255%, below 250%, below 245%, below 240%, below 235%, below 230%, below 225%, below 220%, below 215%, below 200%, below 195%, below 190%, below 185%, below 180%, below 175%, below 170%, below 165%, below 160%, below 155%, below 150%, below 145%, below 140%, below 139%, below 138%, below 137%, below 136%, below 135%, below 134%, below 133%, below 132%, below 131%, below 130%, below 129%, below 128%, below 127%, below 126%, below 125%, below 124%, below 123%, below 122%, below 121%, below 120%, below 119%, below 118%, below 117%, below 116%, or below 115%.

In some embodiments, the % $U_{TM}$ of a uracil-modified sequence encoding a CFTR polypeptide of the present disclosure is above 100%, above 101%, above 102%, above 103%, above 104%, above 105%, above 106%, above 107%, above 108%, above 109%, above 110%, above 111%, above 112%, above 113%, above 114%, above 115%, above 116%, above 117%, above 118%, above 119%, above 120%, above 121%, above 122%, above 123%, above 124%, above 125%, or above 126%, above 127%, above 128%, above 129%, or above 130%.

In some embodiments, the % $U_{TM}$ of a uracil-modified sequence encoding a CFTR polypeptide of the present disclosure is between 122% and 124%, between 121% and 125%, between 120% and 126%, between 119% and 127%, between 118% and 128%, between 117% and 129%, between 116% and 130%, between 115% and 131%, between 114% and 132%, between 113% and 133%, between 112% and 134%, between 111% and 135%, or between 110% and 136%.

In some embodiments, the % $U_{TM}$ of a uracil-modified sequence encoding a CFTR polypeptide of the present disclosure is between about 119% and about 126%, e.g., between 119.64% and 125.68%.

In some embodiments, a uracil-modified sequence encoding a CFTR polypeptide of the present disclosure has a reduced number of consecutive uracils with respect to the corresponding wild-type nucleic acid sequence. For example, two consecutive leucines can be encoded by the sequence CUUUUG, which includes a four uracil cluster. Such a subsequence can be substituted, e.g., with CUGCUC, which removes the uracil cluster.

Phenylalanine can be encoded by UUC or UUU. Thus, even if phenylalanines encoded by UUU are replaced by UUC, the synonymous codon still contains a uracil pair (UU). Accordingly, the number of phenylalanines in a sequence establishes a minimum number of uracil pairs (UU) that cannot be eliminated without altering the number of phenylalanines in the encoded polypeptide. For example, if the polypeptide, e.g., wild type CFTR isoform 1, has e.g., 6, 7, 8, or 9 phenylalanines, the absolute minimum number of uracil pairs (UU) that a uracil-modified sequence encoding the polypeptide, e.g., wild type CFTR isoform 1, can contain is 6, 7, 8, or 9, respectively.

Wild type CFTR isoform 1 contains 170 uracil pairs (UU), and 59 uracil triplets (UUU). In some embodiments, a uracil-modified sequence encoding a CFTR polypeptide of the present disclosure has a reduced number of uracil triplets (UUU) with respect to the wild-type nucleic acid sequence. In some embodiments, a uracil-modified sequence encoding a CFTR polypeptide of the present disclosure contains less than 59, less than 50, less than 40, less than 30, less than 20, less than 15, less than 10, less than 5, 4, 3, 2, 1 or no uracil triplets (UUU).

In some embodiments, a uracil-modified sequence encoding a CFTR polypeptide has a reduced number of uracil pairs (UU) with respect to the number of uracil pairs (UU) in the wild-type nucleic acid sequence. In some embodiments, a uracil-modified sequence encoding a CFTR polypeptide of the present disclosure has a number of uracil pairs (UU) corresponding to the minimum possible number of uracil pairs (UU) in the wild-type nucleic acid sequence, e.g., 9 uracil pairs in the case of wild type CFTR isoform 1.

In some embodiments, a uracil-modified sequence encoding a CFTR polypeptide of the present disclosure has at least 1, 2, 3, 4, 5, 6, 7, 8, 9, 10, 11, 12, 13, 14, 15, 16, 17, 18, 19, 20, 21, 22, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104 or 105 uracil pairs (UU) less than the number of uracil pairs (UU) in the wild-type nucleic acid sequence. In some embodiments, a uracil-modified sequence encoding a CFTR polypeptide of the present disclosure has between 61 and 85 uracil pairs (UU).

The phrase "uracil pairs (UU) relative to the uracil pairs (UU) in the wild type nucleic acid sequence," refers to a parameter determined by dividing the number of uracil pairs (UU) in a sequence-optimized nucleotide sequence by the total number of uracil pairs (UU) in the corresponding wild-type nucleotide sequence and multiplying by 100. This parameter is abbreviated herein as % $UU_{wt}$.

In some embodiments, a uracil-modified sequence encoding a CFTR polypeptide of the present disclosure has a % $UU_{wt}$ less than 90%, less than 85%, less than 80%, less than 75%, less than 70%, less than 65%, less than 60%, less than 65%, less than 60%, less than 55%, less than 50%, less than 40%, less than 30%, or less than 20%.

In some embodiments, a uracil-modified sequence encoding a CFTR polypeptide has a % $UU_{wt}$ between 30% and 55%. In a particular embodiment, a uracil-modified sequence encoding a CFTR polypeptide of the present disclosure has a % $UU_{wt}$ between 35% and 50%.

In some embodiments, the polynucleotide of the present disclosure comprises a uracil-modified sequence encoding a CFTR polypeptide disclosed herein. In some embodiments, the uracil-modified sequence encoding a CFTR polypeptide comprises at least one chemically modified nucleobase, e.g., 5-methoxyuracil. In some embodiments, at least 95% of a nucleobase (e.g., uracil) in a uracil-modified sequence encoding a CFTR polypeptide of the present disclosure are modified nucleobases. In some embodiments, at least 95% of uracil in a uracil-modified sequence encoding a CFTR polypeptide is 5-methoxyuracil. In some embodiments, the polynucleotide comprising a uracil-modified sequence further comprises a miRNA binding site, e.g., a miRNA binding site that binds to miR-142. In some embodiments, the polynucleotide comprising a uracil-modified sequence is formulated with a delivery agent, e.g., a compound having Formula (I), (IA), (II), (IIa), (IIb), (IIc), (IId) or (IIe), e.g., any of Compounds 1-232, e.g., any of Compounds 1-232.

In some embodiments, the "guanine content of the sequence optimized ORF encoding CFTR with respect to the theoretical maximum guanine content of a nucleotide sequence encoding the CFTR polypeptide," abbreviated as % $G_{TMX}$ is at least about 69%, at least about 70%, at least about 71%, at least about 75%, at least about 80%, at least about 85%, at least about 90%, at least about 95%, or about 100%. In some embodiments, the % $G_{TMX}$ is between about 69% and about 80%, between about 70% and about 79%, between about 71% and about 78%, or between about 73% and about 77%.

In some embodiments, the "cytosine content of the ORF relative to the theoretical maximum cytosine content of a nucleotide sequence encoding the CFTR polypeptide," abbreviated as % $C_{TMX}$, is at least 60%, at least about 65%, at least about 69%, at least about 70%, at least about 71%, at least about 75%, at least about 80%, at least about 85%, at least about 90%, at least about 95%, or about 100%. In some embodiments, the % $C_{TMX}$ is between about 60% and about 80%, between about 65% and about 77%, between about 67% and about 74%, or between about 69% and about 72%.

In some embodiments, the "guanine and cytosine content (G/C) of the ORF relative to the theoretical maximum G/C content in a nucleotide sequence encoding the CFTR polypeptide," abbreviated as % $G/C_{TMX}$ is at least about 85%, at least about 90%, at least about 91%, at least about 93%, at least about 95%, or about 100%. The % $G/C_{TMX}$ is between about 80% and about 100%, between about 85% and about 99%, between about 90% and about 96%, or between about 91% and about 94%.

In some embodiments, the "G/C content in the ORF relative to the G/C content in the corresponding wild-type ORF," abbreviated as % $G/C_{WT}$ is at least 102%, at least 103%, at least 104%, at least 105%, at least 106%, at least 107%, at least 110%, at least 115%, at least 120%, at least 125% at least 130%, at least 135%, at least 140%, at least 143% or at least 145%.

In some embodiments, the average G/C content in the 3rd codon position in the ORF is at least 20%, at least 25%, at least 30%, at least 35%, at least 40%, at least 45%, at least 46%, at least 47%, at least 48%, at least 49%, or at least 50% higher than the average G/C content in the 3rd codon position in the corresponding wild-type ORF.

In some embodiments, the polynucleotide of the present disclosure comprises an open reading frame (ORF) encoding a CFTR polypeptide, wherein the ORF has been sequence optimized, and wherein each of % Um, % $U_{WT}$, % $U_{TM}$, % $G_{TL}$, % $G_{WT}$, % $G_{TMX}$, % $C_{TL}$, % $C_{WT}$, % $C_{TMX}$, % $G/C_{TL}$, % $G/C_{WT}$, or % $G/C_{TMX}$, alone or in a combination thereof is in a range between
(i) a maximum corresponding to the parameter's maximum value (MAX) plus about 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV), and
(ii) a minimum corresponding to the parameter's minimum value (MIN) less 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV).

7. Methods for Sequence Optimization

In some embodiments, a polynucleotide of the present disclosure (e.g., a polynucleotide comprising a nucleotide sequence encoding a CFTR polypeptide (e.g., the wild-type sequence, functional fragment, or variant thereof) is sequence optimized. A sequence optimized nucleotide sequence (nucleotide sequence is also referred to as "nucleic acid" herein) comprises at least one codon modification with respect to a reference sequence (e.g., a wild-type sequence encoding a CFTR polypeptide). Thus, in a sequence optimized nucleic acid, at least one codon is different from a corresponding codon in a reference sequence (e.g., a wild-type sequence).

In general, sequence optimized nucleic acids are generated by at least a step comprising substituting codons in a reference sequence with synonymous codons (i.e., codons that encode the same amino acid). Such substitutions can be effected, for example, by applying a codon substitution map (i.e., a table providing the codons that will encode each amino acid in the codon optimized sequence), or by applying a set of rules (e.g., if glycine is next to neutral amino acid, glycine would be encoded by a certain codon, but if it is next to a polar amino acid, it would be encoded by another codon). In addition to codon substitutions (i.e., "codon optimization") the sequence optimization methods disclosed herein comprise additional optimization steps which are not strictly directed to codon optimization such as the removal of deleterious motifs (destabilizing motif substitution). Compositions and formulations comprising these sequence optimized nucleic acids (e.g., a RNA, e.g., an mRNA) can be administered to a subject in need thereof to facilitate in vivo expression of functionally active CFTR.

The recombinant expression of large molecules in cell cultures can be a challenging task with numerous limitations (e.g., poor protein expression levels, stalled translation resulting in truncated expression products, protein misfolding, etc.) These limitations can be reduced or avoided by administering the polynucleotides (e.g., a RNA, e.g., an mRNA), which encode a functionally active CFTR or compositions or formulations comprising the same to a patient suffering from CF, so the synthesis and delivery of the CFTR polypeptide to treat CF takes place endogenously.

Changing from an in vitro expression system (e.g., cell culture) to in vivo expression requires the redesign of the nucleic acid sequence encoding the therapeutic agent. Redesigning a naturally occurring gene sequence by choosing different codons without necessarily altering the encoded amino acid sequence can often lead to dramatic increases in protein expression levels (Gustafsson et al., 2004, Journal/ Trends Biotechnol 22, 346-53). Variables such as codon adaptation index (CAI), mRNA secondary structures, cis-regulatory sequences, GC content and many other similar variables have been shown to somewhat correlate with protein expression levels (Villalobos et al., 2006, "Journal/ BMC Bioinformatics 7, 285). However, due to the degeneracy of the genetic code, there are numerous different nucleic acid sequences that can all encode the same therapeutic agent. Each amino acid is encoded by up to six synonymous codons; and the choice between these codons influences gene expression. In addition, codon usage (i.e., the frequency with which different organisms use codons for expressing a polypeptide sequence) differs among organisms (for example, recombinant production of human or humanized therapeutic antibodies frequently takes place in hamster cell cultures).

In some embodiments, a reference nucleic acid sequence can be sequence optimized by applying a codon map. The skilled artisan will appreciate that the T bases in the codon maps disclosed below are present in DNA, whereas the T bases would be replaced by U bases in corresponding RNAs. For example, a sequence optimized nucleic acid disclosed herein in DNA form, e.g., a vector or an in-vitro translation (IVT) template, would have its T bases transcribed as U based in its corresponding transcribed mRNA. In this respect, both sequence optimized DNA sequences (comprising T) and their corresponding RNA sequences (comprising U) are considered sequence optimized nucleic acid of the present disclosure. A skilled artisan would also understand that equivalent codon-maps can be generated by replaced one or more bases with non-natural bases. Thus, e.g., a TTC codon (DNA map) would correspond to a UUC codon (RNA map), which in turn can correspond to a ΨΨC codon (RNA map in which U has been replaced with pseudouridine).

In one embodiment, a reference sequence encoding CFTR can be optimized by replacing all the codons encoding a certain amino acid with only one of the alternative codons provided in a codon map. For example, all the valines in the optimized sequence would be encoded by GTG or GTC or GTT.

Sequence optimized polynucleotides of the present disclosure can be generated using one or more codon optimization methods, or a combination thereof. Sequence optimization methods which can be used to sequence optimize nucleic acid sequences are described in detail herein. This list of methods is not comprehensive or limiting.

It will be appreciated that the design principles and rules described for each one of the sequence optimization methods discussed below can be combined in many different ways, for example high G/C content sequence optimization for some regions or uridine content sequence optimization for other regions of the reference nucleic acid sequence, as well as targeted nucleotide mutations to minimize secondary structure throughout the sequence or to eliminate deleterious motifs.

The choice of potential combinations of sequence optimization methods can be, for example, dependent on the specific chemistry used to produce a synthetic polynucleotide. Such a choice can also depend on characteristics of the protein encoded by the sequence optimized nucleic acid, e.g., a full sequence, a functional fragment, or a fusion protein comprising CFTR, etc. In some embodiments, such a choice can depend on the specific tissue or cell targeted by the sequence optimized nucleic acid (e.g., a therapeutic synthetic mRNA).

The mechanisms of combining the sequence optimization methods or design rules derived from the application and analysis of the optimization methods can be either simple or complex. For example, the combination can be:
  (i) Sequential: Each sequence optimization method or set of design rules applies to a different subsequence of the overall sequence, for example reducing uridine at codon positions 1 to 30 and then selecting high frequency codons for the remainder of the sequence;
  (ii) Hierarchical: Several sequence optimization methods or sets of design rules are combined in a hierarchical, deterministic fashion. For example, use the most GC-rich codons, breaking ties (which are common) by choosing the most frequent of those codons.
  (iii) Multifactorial/Multiparametric: Machine learning or other modeling techniques are used to design a single sequence that best satisfies multiple overlapping and possibly contradictory requirements. This approach would require the use of a computer applying a number of mathematical techniques, for example, genetic algorithms.

Ultimately, each one of these approaches can result in a specific set of rules which in many cases can be summarized in a single codon table, i.e., a sorted list of codons for each amino acid in the target protein (i.e., CFTR), with a specific rule or set of rules indicating how to select a specific codon for each amino acid position.

a. Uridine Content Optimization

The presence of local high concentrations of uridine in a nucleic acid sequence can have detrimental effects on translation, e.g., slow or prematurely terminated translation, especially when modified uridine analogs are used in the production of synthetic mRNAs. Furthermore, high uridine content can also reduce the in vivo half-life of synthetic mRNAs due to TLR activation.

Accordingly, a nucleic acid sequence can be sequence optimized using a method comprising at least one uridine content optimization step. Such a step comprises, e.g., substituting at least one codon in the reference nucleic acid with an alternative codon to generate a uridine-modified sequence, wherein the uridine-modified sequence has at least one of the following properties:
  (i) increase or decrease in global uridine content;
  (ii) increase or decrease in local uridine content (i.e., changes in uridine content are limited to specific subsequences);
  (iii) changes in uridine distribution without altering the global uridine content;
  (iv) changes in uridine clustering (e.g., number of clusters, location of clusters, or distance between clusters); or
  (v) combinations thereof.

In some embodiments, the sequence optimization process comprises optimizing the global uridine content, i.e., optimizing the percentage of uridine nucleobases in the sequence optimized nucleic acid with respect to the percentage of uridine nucleobases in the reference nucleic acid sequence. For example, 30% of nucleobases can be uridines in the reference sequence and 10% of nucleobases can be uridines in the sequence optimized nucleic acid.

In other embodiments, the sequence optimization process comprises reducing the local uridine content in specific regions of a reference nucleic acid sequence, i.e., reducing the percentage of uridine nucleobases in a subsequence of the sequence optimized nucleic acid with respect to the percentage of uridine nucleobases in the corresponding subsequence of the reference nucleic acid sequence. For example, the reference nucleic acid sequence can have a 5'-end region (e.g., 30 codons) with a local uridine content of 30%, and the uridine content in that same region could be reduced to 10% in the sequence optimized nucleic acid.

In specific embodiments, codons can be replaced in the reference nucleic acid sequence to reduce or modify, for example, the number, size, location, or distribution of uridine clusters that could have deleterious effects on protein translation. Although as a general rule it is desirable to reduce the uridine content of the reference nucleic acid sequence, in certain embodiments the uridine content, and in particular the local uridine content, of some subsequences of the reference nucleic acid sequence can be increased.

The reduction of uridine content to avoid adverse effects on translation can be done in combination with other optimization methods disclosed here to achieve other design goals. For example, uridine content optimization can be combined with ramp design, since using the rarest codons for most amino acids will, with a few exceptions, reduce the U content.

In some embodiments, the uridine-modified sequence is designed to induce a lower Toll-Like Receptor (TLR) response when compared to the reference nucleic acid sequence. Several TLR5 recognize and respond to nucleic acids. Double-stranded (ds)RNA, a frequent viral constituent, has been shown to activate TLR3. See Alexopoulou et al. (2001) Nature, 413:732-738 and Wang et al. (2004) Nat. Med., 10:1366-1373. Single-stranded (ss)RNA activates TLR7. See Diebold et al. (2004) Science 303:1529-1531. RNA oligonucleotides, for example RNA with phosphorothioate internucleotide linkages, are ligands of human TLR8. See Heil et al. (2004) Science 303:1526-1529. DNA containing unmethylated CpG motifs, characteristic of bacterial and viral DNA, activate TLR9. See Hemmi et al. (2000) Nature, 408: 740-745.

As used herein, the term "TLR response" is defined as the recognition of single-stranded RNA by a TLR7 receptor, and in some embodiments encompasses the degradation of the RNA and/or physiological responses caused by the recognition of the single-stranded RNA by the receptor. Methods to determine and quantitate the binding of an RNA to a TLR7 are known in the art. Similarly, methods to determine whether an RNA has triggered a TLR7-mediated physiological response (e.g., cytokine secretion) are well known in the art. In some embodiments, a TLR response can be mediated by TLR3, TLR8, or TLR9 instead of TLR7.

Suppression of TLR7-mediated response can be accomplished via nucleoside modification. RNA undergoes over hundred different nucleoside modifications in nature (see the RNA Modification Database, available at mods.rna.albany.edu). Human rRNA, for example, has ten times more pseudouridine (Ψ) and 25 times more 2'-O-methylated nucleosides than bacterial rRNA. Bacterial mRNA contains no nucleoside modifications, whereas mammalian mRNAs have modified nucleosides such as 5-methylcytidine (m5C), N6-methyladenosine (m6A), inosine and many 2'-O-methylated nucleosides in addition to N7-methylguanosine (m7G).

Uracil and ribose, the two defining features of RNA, are both necessary and sufficient for TLR7 stimulation, and short single-stranded RNA (ssRNA) act as TLR7 agonists in a sequence-independent manner as long as they contain several uridines in close proximity. See Diebold et al. (2006) Eur. J. Immunol. 36:3256-3267, which is herein incorporated by reference in its entirety. Accordingly, one or more of the optimization methods disclosed herein comprises reducing the uridine content (locally and/or locally) and/or reducing or modifying uridine clustering to reduce or to suppress a TLR7-mediated response.

In some embodiments, the TLR response (e.g., a response mediated by TLR7) caused by the uridine-modified sequence is at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% lower than the TLR response caused by the reference nucleic acid sequence.

In some embodiments, the TLR response caused by the reference nucleic acid sequence is at least about 1-fold, at least about 1.1-fold, at least about 1.2-fold, at least about 1.3-fold, at least about 1.4-fold, at least about 1.5-fold, at least about 1.6-fold, at least about 1.7-fold, at least about 1.8-fold, at least about 1.9-fold, at least about 2-fold, at least about 3-fold, at least about 4-fold, at least about 5-fold, at least about 6-fold, at least about 7-fold, at least about 8-fold, at least about 9-fold, or at least about 10-fold higher than the TLR response caused by the uridine-modified sequence.

In some embodiments, the uridine content (average global uridine content) (absolute or relative) of the uridine-modified sequence is higher than the uridine content (absolute or relative) of the reference nucleic acid sequence. Accordingly, in some embodiments, the uridine-modified sequence contains at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% more uridine that the reference nucleic acid sequence.

In other embodiments, the uridine content (average global uridine content) (absolute or relative) of the uridine-modified sequence is lower than the uridine content (absolute or relative) of the reference nucleic acid sequence. Accordingly, in some embodiments, the uridine-modified sequence contains at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% less uridine that the reference nucleic acid sequence.

In some embodiments, the uridine content (average global uridine content) (absolute or relative) of the uridine-modified sequence is less than 50%, 49%, 48%, 47%, 46%, 45%, 44%, 43%, 42%, 41%, 40%, 39%, 38%, 37%, 36%, 35%, 34%, 33%, 32%, 31%, 30%, 29%, 28%, 27%, 26%, 25%, 24%, 23%, 22%, 21%, 20%, 19%, 18%, 17%, 16%, 15%, 14%, 13%, 12%, 11%, 10%, 9%, 8%, 7%, 6%, 5%, 4%, 3%, 2% or 1% of the total nucleobases in the uridine-modified sequence. In some embodiments, the uridine content of the uridine-modified sequence is between about 10% and about 20%. In some particular embodiments, the uridine content of the uridine-modified sequence is between about 12% and about 16%.

In some embodiments, the uridine content of the reference nucleic acid sequence can be measured using a sliding window. In some embodiments, the length of the sliding window is 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 nucleobases. In some embodiments, the sliding window is over 40 nucleobases in length. In some embodiments, the sliding window is 20 nucleobases in length. Based on the uridine content measured with a sliding window, it is possible to generate a histogram representing the uridine content throughout the length of the reference nucleic acid sequence and sequence optimized nucleic acids.

In some embodiments, a reference nucleic acid sequence can be modified to reduce or eliminate peaks in the histogram that are above or below a certain percentage value. In some embodiments, the reference nucleic acid sequence can be modified to eliminate peaks in the sliding-window representation which are above 65%, 60%, 55%, 50%, 45%, 40%, 35%, or 30% uridine. In another embodiment, the reference nucleic acid sequence can be modified so no peaks are over 30% uridine in the sequence optimized nucleic acid, as measured using a 20 nucleobase sliding window. In some embodiments, the reference nucleic acid sequence can be modified so no more or no less than a predetermined number of peaks in the sequence optimized nucleic sequence, as measured using a 20 nucleobase sliding window, are above or below a certain threshold value. For example, in some embodiments, the reference nucleic acid sequence can be modified so no peaks or no more than 1, 2, 3, 4, 5, 6, 7, 8, 9 or 10 peaks in the sequence optimized nucleic acid are above 10%, 15%, 20%, 25% or 30% uridine. In another embodiment, the sequence optimized nucleic acid contains between 0 peaks and 2 peaks with uridine contents 30% of higher.

In some embodiments, a reference nucleic acid sequence can be sequence optimized to reduce the incidence of consecutive uridines. For example, two consecutive leucines could be encoded by the sequence CUUUUG, which would include a four uridine cluster. Such subsequence could be substituted with CUGCUC, which would effectively remove the uridine cluster. Accordingly, a reference nucleic sequence can be sequence optimized by reducing or eliminating uridine pairs (UU), uridine triplets (UUU) or uridine quadruplets (UUUU). Higher order combinations of U are not considered combinations of lower order combinations. Thus, for example, UUUU is strictly considered a quadruplet, not two consecutive U pairs; or UUUUUU is considered a sextuplet, not three consecutive U pairs, or two consecutive U triplets, etc.

In some embodiments, all uridine pairs (UU) and/or uridine triplets (UUU) and/or uridine quadruplets (UUUU) can be removed from the reference nucleic acid sequence. In other embodiments, uridine pairs (UU) and/or uridine triplets (UUU) and/or uridine quadruplets (UUUU) can be reduced below a certain threshold, e.g., no more than 1, 2, 3, 4, 5, 6, 7, 8, 9, 10, 11, 12, 13, 14, 15, 16, 17, 18, 19, or 20 occurrences in the sequence optimized nucleic acid. In a particular embodiment, the sequence optimized nucleic acid contains less than 20, 19, 18, 17, 16, 15, 14, 13, 12, 11, 10, 9, 8, 7, 6, 5, 4, 3, 2, or 1 uridine pairs. In another particular embodiment, the sequence optimized nucleic acid contains no uridine pairs and/or triplets.

Phenylalanine codons, i.e., UUC or UUU, comprise a uridine pair or triples and therefore sequence optimization to reduce uridine content can at most reduce the phenylalanine U triplet to a phenylalanine U pair. In some embodiments, the occurrence of uridine pairs (UU) and/or uridine triplets (UUU) refers only to non-phenylalanine U pairs or triplets. Accordingly, in some embodiments, non-phenylalanine uridine pairs (UU) and/or uridine triplets (UUU) can be reduced below a certain threshold, e.g., no more than 1, 2, 3, 4, 5, 6, 7, 8, 9, 10, 11, 12, 13, 14, 15, 16, 17, 18, 19, or 20 occurrences in the sequence optimized nucleic acid. In a particular embodiment, the sequence optimized nucleic acid contains less than 20, 19, 18, 17, 16, 15, 14, 13, 12, 11, 10, 9, 8, 7, 6, 5, 4, 3, 2, or 1 non-phenylalanine uridine pairs and/or triplets. In another particular embodiment, the sequence optimized nucleic acid contains no non-phenylalanine uridine pairs and/or triplets.

In some embodiments, the reduction in uridine combinations (e.g., pairs, triplets, quadruplets) in the sequence optimized nucleic acid can be expressed as a percentage reduction with respect to the uridine combinations present in the reference nucleic acid sequence.

In some embodiments, a sequence optimized nucleic acid can contain about 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 55%, 60%, or 65% of the total number of uridine pairs present in the reference nucleic acid sequence. In some embodiments, a sequence optimized nucleic acid can contain about 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 55%, 60%, or 65% of the total number of uridine triplets present in the reference nucleic acid sequence. In some embodiments, a sequence optimized nucleic acid can contain about 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 55%, 60%, or 65% of the total number of uridine quadruplets present in the reference nucleic acid sequence.

In some embodiments, a sequence optimized nucleic acid can contain about 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 55%, 60%, or 65% of the total number of non-phenylalanine uridine pairs present in the reference nucleic acid sequence. In some embodiments, a sequence optimized nucleic acid can contain about 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 55%, 60%, or 65% of the total number of non-phenylalanine uridine triplets present in the reference nucleic acid sequence.

In some embodiments, the uridine content in the sequence optimized sequence can be expressed with respect to the theoretical minimum uridine content in the sequence. The term "theoretical minimum uridine content" is defined as the uridine content of a nucleic acid sequence as a percentage of the sequence's length after all the codons in the sequence have been replaced with synonymous codon with the lowest uridine content. In some embodiments, the uridine content of the sequence optimized nucleic acid is identical to the theoretical minimum uridine content of the reference sequence (e.g., a wild type sequence). In some aspects, the uridine content of the sequence optimized nucleic acid is about 90%, about 95%, about 100%, about 105%, about 110%, about 115%, about 120%, about 125%, about 130%, about 135%, about 140%, about 145%, about 150%, about 155%, about 160%, about 165%, about 170%, about 175%, about 180%, about 185%, about 190%, about 195% or about 200% of the theoretical minimum uridine content of the reference sequence (e.g., a wild type sequence).

In some embodiments, the uridine content of the sequence optimized nucleic acid is identical to the theoretical minimum uridine content of the reference sequence (e.g., a wild type sequence).

The reference nucleic acid sequence (e.g., a wild type sequence) can comprise uridine clusters which due to their number, size, location, distribution or combinations thereof have negative effects on translation. As used herein, the term "uridine cluster" refers to a subsequence in a reference nucleic acid sequence or sequence optimized nucleic sequence with contains a uridine content (usually described as a percentage) which is above a certain threshold. Thus, in certain embodiments, if a subsequence comprises more than about 10%, 15%, 20%, 25%, 30%, 35%, 40%, 45%, 50%, 55%, 60% or 65% uridine content, such subsequence would be considered a uridine cluster.

The negative effects of uridine clusters can be, for example, eliciting a TLR7 response. Thus, in some implementations of the nucleic acid sequence optimization methods disclosed herein it is desirable to reduce the number of clusters, size of clusters, location of clusters (e.g., close to the 5' and/or 3' end of a nucleic acid sequence), distance between clusters, or distribution of uridine clusters (e.g., a certain pattern of cluster along a nucleic acid sequence, distribution of clusters with respect to secondary structure elements in the expressed product, or distribution of clusters with respect to the secondary structure of an mRNA).

In some embodiments, the reference nucleic acid sequence comprises at least one uridine cluster, wherein said uridine cluster is a subsequence of the reference nucleic acid sequence wherein the percentage of total uridine nucleobases in said subsequence is above a predetermined threshold. In some embodiments, the length of the subsequence is at least about 10, at least about 15, at least about 20, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95, or at least about 100 nucleobases. In some embodiments, the subsequence is longer than 100 nucleobases. In some embodiments, the threshold is 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24% or 25% uridine content. In some embodiments, the threshold is above 25%.

For example, an amino acid sequence comprising A, D, G, S and R could be encoded by the nucleic acid sequence GCU, GAU, GGU, AGU, CGU. Although such sequence does not contain any uridine pairs, triplets, or quadruplets, one third of the nucleobases would be uridines. Such a uridine cluster could be removed by using alternative codons, for example, by using GCC, GAC, GGC, AGC, and CGC, which would contain no uridines.

In other embodiments, the reference nucleic acid sequence comprises at least one uridine cluster, wherein said uridine cluster is a subsequence of the reference nucleic acid sequence wherein the percentage of uridine nucleobases of said subsequence as measured using a sliding window that is above a predetermined threshold. In some embodiments, the length of the sliding window is 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 nucleobases. In some embodiments, the sliding window is over 40 nucleobases in length. In some embodiments, the threshold is 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24% or 25% uridine content. In some embodiments, the threshold is above 25%.

In some embodiments, the reference nucleic acid sequence comprises at least two uridine clusters. In some embodiments, the uridine-modified sequence contains fewer uridine-rich clusters than the reference nucleic acid sequence. In some embodiments, the uridine-modified sequence contains more uridine-rich clusters than the reference nucleic acid sequence. In some embodiments, the uridine-modified sequence contains uridine-rich clusters with are shorter in length than corresponding uridine-rich clusters in the reference nucleic acid sequence. In other embodiments, the uridine-modified sequence contains uridine-rich clusters which are longer in length than the corresponding uridine-rich cluster in the reference nucleic acid sequence.

See, Kariko et al. (2005) Immunity 23:165-175; Kormann et al. (2010) Nature Biotechnology 29:154-157; or Sahin et al. (2014) Nature Reviews Drug Discovery|AOP, published online 19 Sep. 2014m doi:10.1038/nrd4278; all of which are herein incorporated by reference their entireties.

b. Guanine/Cytosine (G/C) Content

A reference nucleic acid sequence can be sequence optimized using methods comprising altering the Guanine/Cytosine (G/C) content (absolute or relative) of the reference nucleic acid sequence. Such optimization can comprise altering (e.g., increasing or decreasing) the global G/C content (absolute or relative) of the reference nucleic acid sequence; introducing local changes in G/C content in the reference nucleic acid sequence (e.g., increase or decrease G/C in selected regions or subsequences in the reference nucleic acid sequence); altering the frequency, size, and distribution of G/C clusters in the reference nucleic acid sequence, or combinations thereof.

In some embodiments, the sequence optimized nucleic acid encoding CFTR comprises an overall increase in G/C content (absolute or relative) relative to the G/C content (absolute or relative) of the reference nucleic acid sequence. In some embodiments, the overall increase in G/C content (absolute or relative) is at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% relative to the G/C content (absolute or relative) of the reference nucleic acid sequence.

In some embodiments, the sequence optimized nucleic acid encoding CFTR comprises an overall decrease in G/C content (absolute or relative) relative to the G/C content of the reference nucleic acid sequence. In some embodiments, the overall decrease in G/C content (absolute or relative) is at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% relative to the G/C content (absolute or relative) of the reference nucleic acid sequence.

In some embodiments, the sequence optimized nucleic acid encoding CFTR comprises a local increase in Guanine/Cytosine (G/C) content (absolute or relative) in a subsequence (i.e., a G/C modified subsequence) relative to the G/C content (absolute or relative) of the corresponding subsequence in the reference nucleic acid sequence. In some embodiments, the local increase in G/C content (absolute or relative) is by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% relative to the G/C content (absolute or relative) of the corresponding subsequence in the reference nucleic acid sequence.

In some embodiments, the sequence optimized nucleic acid encoding CFTR comprises a local decrease in Guanine/Cytosine (G/C) content (absolute or relative) in a subsequence (i.e., a G/C modified subsequence) relative to the G/C content (absolute or relative) of the corresponding subsequence in the reference nucleic acid sequence. In some embodiments, the local decrease in G/C content (absolute or relative) is by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% relative to the G/C content (absolute or relative) of the corresponding subsequence in the reference nucleic acid sequence.

In some embodiments, the G/C content (absolute or relative) is increased or decreased in a subsequence which is at least about 5, 10, 15, 20, 25, 30, 35, 40, 45, 50, 55, 60, 65, 70, 75, 80, 85, 90, 95, or 100 nucleobases in length.

In some embodiments, the G/C content (absolute or relative) is increased or decreased in a subsequence which is at least about 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, or 1000 nucleobases in length.

In some embodiments, the G/C content (absolute or relative) is increased or decreased in a subsequence which is at least about 1100, 1200, 1300, 1400, 1500, 1600, 1700, 1800, 1900, 2000, 2100, 2200, 2300, 2400, 2500, 2600, 2700, 2800, 2900, 3000, 3100, 3200, 3300, 3400, 3500, 3600, 3700, 3800, 3900, 4000, 4100, 4200, 4300, 4400, 4500, 4600, 4700, 4800, 4900, 5000, 5100, 5200, 5300, 5400, 5500, 5600, 5700, 5800, 5900, 6000, 6100, 6200, 6300, 6400, 6500, 6600, 6700, 6800, 6900, 7000, 7100, 7200, 7300, 7400, 7500, 7600, 7700, 7800, 7900, 8000, 8100, 8200, 8300, 8400, 8500, 8600, 8700, 8800, 8900, 9000, 9100, 9200, 9300, 9400, 9500, 9600, 9700, 9800, 9900, or 10000 nucleobases in length.

The increases or decreases in G and C content (absolute or relative) described herein can be conducted by replacing synonymous codons with low G/C content with synonymous codons having higher G/C content, or vice versa. For example, L has 6 synonymous codons: two of them have 2 G/C (CUC, CUG), 3 have a single G/C (UUG, CUU, CUA), and one has no G/C (UUA). So if the reference nucleic acid had a CUC codon in a certain position, G/C content at that position could be reduced by replacing CUC with any of the codons having a single G/C or the codon with no G/C.

See, U.S. Publ. Nos. US20140228558, US20050032730 A1; Gustafsson et al. (2012) Protein Expression and Purification 83: 37-46; all of which are incorporated herein by reference in their entireties.

c. Codon Frequency—Codon Usage Bias

Numerous codon optimization methods known in the art are based on the substitution of codons in a reference nucleic acid sequence with codons having higher frequencies. Thus, in some embodiments, a nucleic acid sequence encoding CFTR disclosed herein can be sequence optimized using methods comprising the use of modifications in the frequency of use of one or more codons relative to other synonymous codons in the sequence optimized nucleic acid with respect to the frequency of use in the non-codon optimized sequence.

As used herein, the term "codon frequency" refers to codon usage bias, i.e., the differences in the frequency of occurrence of synonymous codons in coding DNA/RNA. It is generally acknowledged that codon preferences reflect a balance between mutational biases and natural selection for translational optimization. Optimal codons help to achieve faster translation rates and high accuracy. As a result of these factors, translational selection is expected to be stronger in highly expressed genes. In the field of bioinformatics and computational biology, many statistical methods have been proposed and used to analyze codon usage bias. See, e.g., Comeron & Aguade (1998) J. Mol. Evol. 47: 268-74. Methods such as the 'frequency of optimal codons' (Fop) (Ikemura (1981) J. Mol. Biol. 151 (3): 389-409), the Relative Codon Adaptation (RCA) (Fox & Eril (2010) DNA Res. 17 (3): 185-96) or the 'Codon Adaptation Index' (CAI) (Sharp & Li (1987) Nucleic Acids Res. 15 (3): 1281-95) are used to predict gene expression levels, while methods such as the 'effective number of codons' (Nc) and Shannon entropy from information theory are used to measure codon usage evenness. Multivariate statistical methods, such as correspondence analysis and principal component analysis, are widely used to analyze variations in codon usage among genes (Suzuki et al. (2008) DNA Res. 15 (6): 357-65; Sandhu et al., In Silico Biol. 2008; 8(2):187-92).

The nucleic acid sequence encoding a CFTR polypeptide disclosed herein (e.g., a wild type nucleic acid sequence, a mutant nucleic acid sequence, a chimeric nucleic sequence, etc. which can be, for example, an mRNA), can be codon optimized using methods comprising substituting at least one codon in the reference nucleic acid sequence with an alternative codon having a higher or lower codon frequency in the synonymous codon set; wherein the resulting sequence optimized nucleic acid has at least one optimized property with respect to the reference nucleic acid sequence.

In some embodiments, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99%, or 100% of the codons in the reference nucleic acid sequence encoding CFTR are substituted with alternative codons, each alternative codon having a codon frequency higher than the codon frequency of the substituted codon in the synonymous codon set.

In some embodiments, at least one codon in the reference nucleic acid sequence encoding CFTR is substituted with an alternative codon having a codon frequency higher than the codon frequency of the substituted codon in the synonymous codon set, and at least one codon in the reference nucleic acid sequence is substituted with an alternative codon having a codon frequency lower than the codon frequency of the substituted codon in the synonymous codon set.

In some embodiments, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, or at least about 75% of the codons in the reference nucleic acid sequence encoding CFTR are substituted with alternative codons, each alternative codon having a codon frequency higher than the codon frequency of the substituted codon in the synonymous codon set.

In some embodiments, at least one alternative codon having a higher codon frequency has the highest codon frequency in the synonymous codon set. In other embodiments, all alternative codons having a higher codon frequency have the highest codon frequency in the synonymous codon set.

In some embodiments, at least one alternative codon having a lower codon frequency has the lowest codon frequency in the synonymous codon set. In some embodiments, all alternative codons having a higher codon frequency have the highest codon frequency in the synonymous codon set.

In some specific embodiments, at least one alternative codon has the second highest, the third highest, the fourth highest, the fifth highest or the sixth highest frequency in the synonymous codon set. In some specific embodiments, at least one alternative codon has the second lowest, the third lowest, the fourth lowest, the fifth lowest, or the sixth lowest frequency in the synonymous codon set.

Optimization based on codon frequency can be applied globally, as described above, or locally to the reference nucleic acid sequence encoding a CFTR polypeptide. In some embodiments, when applied locally, regions of the reference nucleic acid sequence can modified based on codon frequency, substituting all or a certain percentage of codons in a certain subsequence with codons that have higher or lower frequencies in their respective synonymous codon sets. Thus, in some embodiments, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99%, or 100% of the codons in a subsequence of the reference nucleic acid sequence are substituted with alternative codons, each alternative codon having a codon frequency higher than the codon frequency of the substituted codon in the synonymous codon set.

In some embodiments, at least one codon in a subsequence of the reference nucleic acid sequence encoding a CFTR polypeptide is substituted with an alternative codon having a codon frequency higher than the codon frequency of the substituted codon in the synonymous codon set, and at least one codon in a subsequence of the reference nucleic acid sequence is substituted with an alternative codon having a codon frequency lower than the codon frequency of the substituted codon in the synonymous codon set.

In some embodiments, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, or at least about 75% of the codons in a subsequence of the reference nucleic acid sequence encoding a CFTR polypeptide are substituted with alternative codons, each alternative codon having a codon frequency higher than the codon frequency of the substituted codon in the synonymous codon set.

In some embodiments, at least one alternative codon substituted in a subsequence of the reference nucleic acid sequence encoding a CFTR polypeptide and having a higher codon frequency has the highest codon frequency in the synonymous codon set. In other embodiments, all alternative codons substituted in a subsequence of the reference nucleic acid sequence and having a lower codon frequency have the lowest codon frequency in the synonymous codon set.

In some embodiments, at least one alternative codon substituted in a subsequence of the reference nucleic acid sequence encoding a CFTR polypeptide and having a lower codon frequency has the lowest codon frequency in the synonymous codon set. In some embodiments, all alternative codons substituted in a subsequence of the reference nucleic acid sequence and having a higher codon frequency have the highest codon frequency in the synonymous codon set.

In specific embodiments, a sequence optimized nucleic acid encoding a CFTR polypeptide can comprise a subsequence having an overall codon frequency higher or lower than the overall codon frequency in the corresponding subsequence of the reference nucleic acid sequence at a specific location, for example, at the 5' end or 3' end of the sequence optimized nucleic acid, or within a predetermined distance from those region (e.g., at least 1, 2, 3, 4, 5, 6, 7, 8, 9, 10, 15, 20, 25, 30, 35, 40, 45, 50, 55, 60, 65, 70, 75, 80, 85, 90, 95 or 100 codons from the 5' end or 3' end of the sequence optimized nucleic acid).

In some embodiments, an sequence optimized nucleic acid encoding a CFTR polypeptide can comprise more than one subsequence having an overall codon frequency higher or lower than the overall codon frequency in the corresponding subsequence of the reference nucleic acid sequence. A skilled artisan would understand that subsequences with overall higher or lower overall codon frequencies can be organized in innumerable patterns, depending on whether the overall codon frequency is higher or lower, the length of the subsequence, the distance between subsequences, the location of the subsequences, etc.

See, U.S. Pat. Nos. 5,082,767, 8,126,653, 7,561,973, 8,401,798; U.S. Publ. No. US 20080046192, US 20080076161; Int'l. Publ. No. WO2000018778; Welch et al. (2009) PLoS ONE 4(9): e7002; Gustafsson et al. (2012) Protein Expression and Purification 83: 37-46; Chung et al. (2012) BMC Systems Biology 6:134; all of which are incorporated herein by reference in their entireties.

d. Destabilizing Motif Substitution

There is a variety of motifs that can affect sequence optimization, which fall into various non-exclusive categories, for example:

(i) Primary sequence based motifs: Motifs defined by a simple arrangement of nucleotides.

(ii) Structural motifs: Motifs encoded by an arrangement of nucleotides that tends to form a certain secondary structure.

(iii) Local motifs: Motifs encoded in one contiguous subsequence.

(iv) Distributed motifs: Motifs encoded in two or more disjoint subsequences.

(v) Advantageous motifs: Motifs which improve nucleotide structure or function.

(vi) Disadvantageous motifs: Motifs with detrimental effects on nucleotide structure or function.

There are many motifs that fit into the category of disadvantageous motifs. Some examples include, for example, restriction enzyme motifs, which tend to be relatively short, exact sequences such as the restriction site motifs for Xba1 (TCTAGA), EcoRI (GAATTC), EcoRII (CCWGG, wherein W means A or T, per the IUPAC ambiguity codes), or HindIII (AAGCTT); enzyme sites, which tend to be longer and based on consensus not exact sequence, such in the T7 RNA polymerase (GnnnnWn-CRnCTCnCnnWnD, wherein n means any nucleotide, R means A or G, W means A or T, D means A or G or T but not C); structural motifs, such as GGGG repeats (Kim et al. (1991) Nature 351(6324):331-2); or other motifs such as CUG-triplet repeats (Querido et al. (2014) J. Cell Sci. 124:1703-1714).

Accordingly, the nucleic acid sequence encoding a CFTR polypeptide disclosed herein can be sequence optimized using methods comprising substituting at least one destabilizing motif in a reference nucleic acid sequence, and removing such disadvantageous motif or replacing it with an advantageous motif In some embodiments, the optimization process comprises identifying advantageous and/or disadvantageous motifs in the reference nucleic sequence, wherein such motifs are, e.g., specific subsequences that can cause a loss of stability in the reference nucleic acid sequence prior or during the optimization process. For example, substitution of specific bases during optimization can generate a subsequence (motif) recognized by a restriction enzyme. Accordingly, during the optimization process the appearance of disadvantageous motifs can be monitored by comparing the sequence optimized sequence with a library of motifs known to be disadvantageous. Then, the identification of disadvantageous motifs could be used as a post-hoc filter, i.e., to determine whether a certain modification which potentially could be introduced in the reference nucleic acid sequence should be actually implemented or not.

In some embodiments, the identification of disadvantageous motifs can be used prior to the application of the sequence optimization methods disclosed herein, i.e., the identification of motifs in the reference nucleic acid sequence encoding a CFTR polypeptide and their replacement with alternative nucleic acid sequences can be used as a preprocessing step, for example, before uridine reduction.

In other embodiments, the identification of disadvantageous motifs and their removal is used as an additional sequence optimization technique integrated in a multiparametric nucleic acid optimization method comprising two or more of the sequence optimization methods disclosed herein. When used in this fashion, a disadvantageous motif identified during the optimization process would be removed, for example, by substituting the lowest possible number of nucleobases in order to preserve as closely as possible the original design principle(s) (e.g., low U, high frequency, etc.).

See, e.g., U.S. Publ. Nos. US20140228558, US20050032730, or US20140228558, which are herein incorporated by reference in their entireties.

e. Limited Codon Set Optimization

In some particular embodiments, sequence optimization of a reference nucleic acid sequence encoding a CFTR polypeptide can be conducted using a limited codon set, e.g., a codon set wherein less than the native number of codons is used to encode the 20 natural amino acids, a subset of the 20 natural amino acids, or an expanded set of amino acids including, for example, non-natural amino acids.

The genetic code is highly similar among all organisms and can be expressed in a simple table with 64 entries which would encode the 20 standard amino acids involved in protein translation plus start and stop codons. The genetic code is degenerate, i.e., in general, more than one codon specifies each amino acid. For example, the amino acid leucine is specified by the UUA, UUG, CUU, CUC, CUA, or CUG codons, while the amino acid serine is specified by UCA, UCG, UCC, UCU, AGU, or AGC codons (difference in the first, second, or third position). Native genetic codes comprise 62 codons encoding naturally occurring amino acids. Thus, in some embodiments of the methods disclosed herein optimized codon sets (genetic codes) comprising less than 62 codons to encode 20 amino acids can comprise 61, 60, 59, 58, 57, 56, 55, 54, 53, 52, 51, 50, 49, 48, 47, 46, 45, 44, 43, 42, 41, 40, 39, 38, 37, 36, 35, 34, 33, 32, 31, 30, 30, 29, 28, 27, 26, 25, 24, 23, 22, 21, or 20 codons.

In some embodiments, the limited codon set comprises less than 20 codons. For example, if a protein contains less than 20 types of amino acids, such protein could be encoded by a codon set with less than 20 codons. Accordingly, in some embodiments, an optimized codon set comprises as many codons as different types of amino acids are present in the protein encoded by the reference nucleic acid sequence. In some embodiments, the optimized codon set comprises 19, 18, 17, 16, 15, 14, 13, 12, 11, 10, 9, 8, 7, 6, 5, 4, 3, 2 or even 1 codon.

In some embodiments, at least one amino acid selected from the group consisting of Ala, Arg, Asn, Asp, Cys, Gln, Glu, Gly, His, Ile, Leu, Lys, Phe, Pro, Ser, Thr, Tyr, and Val, i.e., amino acids which are naturally encoded by more than one codon, is encoded with less codons than the naturally occurring number of synonymous codons. For example, in some embodiments, Ala can be encoded in the sequence optimized nucleic acid by 3, 2 or 1 codons; Cys can be encoded in the sequence optimized nucleic acid by 1 codon; Asp can be encoded in the sequence optimized nucleic acid by 1 codon; Glu can be encoded in the sequence optimized nucleic acid by 1 codon; Phe can be encoded in the sequence optimized nucleic acid by 1 codon; Gly can be encoded in the sequence optimized nucleic acid by 3 codons, 2 codons or 1 codon; His can be encoded in the sequence optimized nucleic acid by 1 codon; Ile can be encoded in the sequence optimized nucleic acid by 2 codons or 1 codon; Lys can be encoded in the sequence optimized nucleic acid by 1 codon; Leu can be encoded in the sequence optimized nucleic acid by 5 codons, 4 codons, 3 codons, 2 codons or 1 codon; Asn can be encoded in the sequence optimized nucleic acid by 1 codon; Pro can be encoded in the sequence optimized nucleic acid by 3 codons, 2 codons, or 1 codon; Gln can be encoded in the sequence optimized nucleic acid by 1 codon; Arg can be encoded in the sequence optimized nucleic acid by 5 codons, 4 codons, 3 codons, 2 codons, or 1 codon; Ser can be encoded in the sequence optimized nucleic acid by 5 codons, 4 codons, 3 codons, 2 codons, or 1 codon; Thr can be encoded in the sequence optimized nucleic acid by 3 codons, 2 codons, or 1 codon; Val can be encoded in the sequence optimized nucleic acid by 3 codons, 2 codons, or 1 codon; and, Tyr can be encoded in the sequence optimized nucleic acid by 1 codon.

In some embodiments, at least one amino acid selected from the group consisting of Ala, Arg, Asn, Asp, Cys, Gln, Glu, Gly, His, Ile, Leu, Lys, Phe, Pro, Ser, Thr, Tyr, and Val, i.e., amino acids which are naturally encoded by more than one codon, is encoded by a single codon in the limited codon set.

In some specific embodiments, the sequence optimized nucleic acid is a DNA and the limited codon set consists of 20 codons, wherein each codon encodes one of 20 amino acids. In some embodiments, the sequence optimized nucleic acid is a DNA and the limited codon set comprises at least one codon selected from the group consisting of GCT, GCC, GCA, and GCG; at least a codon selected from the group consisting of CGT, CGC, CGA, CGG, AGA, and AGG; at least a codon selected from AAT or ACC; at least a codon selected from GAT or GAC; at least a codon selected from TGT or TGC; at least a codon selected from CAA or CAG; at least a codon selected from GAA or GAG;

at least a codon selected from the group consisting of GGT, GGC, GGA, and GGG; at least a codon selected from CAT or CAC; at least a codon selected from the group consisting of ATT, ATC, and ATA; at least a codon selected from the group consisting of TTA, TTG, CTT, CTC, CTA, and CTG; at least a codon selected from AAA or AAG; an ATG codon; at least a codon selected from TTT or TTC; at least a codon selected from the group consisting of CCT, CCC, CCA, and CCG; at least a codon selected from the group consisting of TCT, TCC, TCA, TCG, AGT, and AGC; at least a codon selected from the group consisting of ACT, ACC, ACA, and ACG; a TGG codon; at least a codon selected from TAT or TAC; and, at least a codon selected from the group consisting of GTT, GTC, GTA, and GTG.

In other embodiments, the sequence optimized nucleic acid is an RNA (e.g., an mRNA) and the limited codon set consists of 20 codons, wherein each codon encodes one of 20 amino acids. In some embodiments, the sequence optimized nucleic acid is an RNA and the limited codon set comprises at least one codon selected from the group consisting of GCU, GCC, GCA, and GCG; at least a codon selected from the group consisting of CGU, CGC, CGA, CGG, AGA, and AGG; at least a codon selected from AAU or ACC; at least a codon selected from GAU or GAC; at least a codon selected from UGU or UGC; at least a codon selected from CAA or CAG; at least a codon selected from GAA or GAG; at least a codon selected from the group consisting of GGU, GGC, GGA, and GGG; at least a codon selected from CAU or CAC; at least a codon selected from the group consisting of AUU, AUC, and AUA; at least a codon selected from the group consisting of UUA, UUG, CUU, CUC, CUA, and CUG; at least a codon selected from AAA or AAG; an AUG codon; at least a codon selected from UUU or UUC; at least a codon selected from the group consisting of CCU, CCC, CCA, and CCG; at least a codon selected from the group consisting of UCU, UCC, UCA, UCG, AGU, and AGC; at least a codon selected from the group consisting of ACU, ACC, ACA, and ACG; a UGG codon; at least a codon selected from UAU or UAC; and, at least a codon selected from the group consisting of GUU, GUC, GUA, and GUG.

In some specific embodiments, the limited codon set has been optimized for in vivo expression of a sequence optimized nucleic acid (e.g., a synthetic mRNA) following administration to a certain tissue or cell.

In some embodiments, the optimized codon set (e.g., a 20 codon set encoding 20 amino acids) complies at least with one of the following properties:
(i) the optimized codon set has a higher average G/C content than the original or native codon set; or,
(ii) the optimized codon set has a lower average U content than the original or native codon set; or,
(iii) the optimized codon set is composed of codons with the highest frequency; or,
(iv) the optimized codon set is composed of codons with the lowest frequency; or,
(v) a combination thereof.

In some specific embodiments, at least one codon in the optimized codon set has the second highest, the third highest, the fourth highest, the fifth highest or the sixth highest frequency in the synonymous codon set. In some specific embodiments, at least one codon in the optimized codon has the second lowest, the third lowest, the fourth lowest, the fifth lowest, or the sixth lowest frequency in the synonymous codon set.

As used herein, the term "native codon set" refers to the codon set used natively by the source organism to encode the reference nucleic acid sequence. As used herein, the term "original codon set" refers to the codon set used to encode the reference nucleic acid sequence before the beginning of sequence optimization, or to a codon set used to encode an optimized variant of the reference nucleic acid sequence at the beginning of a new optimization iteration when sequence optimization is applied iteratively or recursively.

In some embodiments, 5%, 10%, 15%, 20%, 25%, 30%, 35%, 40%, 45%, 50%, 55%, 60%, 65%, 70%, 75%, 80%, 85%, 90%, 95% or 100% of codons in the codon set are those with the highest frequency. In other embodiments, 5%, 10%, 15%, 20%, 25%, 30%, 35%, 40%, 45%, 50%, 55%, 60%, 65%, 70%, 75%, 80%, 85%, 90%, 95% or 100% of codons in the codon set are those with the lowest frequency.

In some embodiments, 5%, 10%, 15%, 20%, 25%, 30%, 35%, 40%, 45%, 50%, 55%, 60%, 65%, 70%, 75%, 80%, 85%, 90%, 95% or 100% of codons in the codon set are those with the highest uridine content. In some embodiments, 5%, 10%, 15%, 20%, 25%, 30%, 35%, 40%, 45%, 50%, 55%, 60%, 65%, 70%, 75%, 80%, 85%, 90%, 95% or 100% of codons in the codon set are those with the lowest uridine content.

In some embodiments, the average G/C content (absolute or relative) of the codon set is 5%, 10%, 15%, 20%, 25%, 30%, 35%, 40%, 45%, 50%, 55%, 60%, 65%, 70%, 75%, 80%, 85%, 90%, 95% or 100% higher than the average G/C content (absolute or relative) of the original codon set. In some embodiments, the average G/C content (absolute or relative) of the codon set is 5%, 10%, 15%, 20%, 25%, 30%, 35%, 40%, 45%, 50%, 55%, 60%, 65%, 70%, 75%, 80%, 85%, 90%, 95% or 100% lower than the average G/C content (absolute or relative) of the original codon set.

In some embodiments, the uracil content (absolute or relative) of the codon set is 5%, 10%, 15%, 20%, 25%, 30%, 35%, 40%, 45%, 50%, 55%, 60%, 65%, 70%, 75%, 80%, 85%, 90%, 95% or 100% higher than the average uracil content (absolute or relative) of the original codon set. In some embodiments, the uracil content (absolute or relative) of the codon set is 5%, 10%, 15%, 20%, 25%, 30%, 35%, 40%, 45%, 50%, 55%, 60%, 65%, 70%, 75%, 80%, 85%, 90%, 95% or 100% lower than the average uracil content (absolute or relative) of the original codon set.

See also U.S. Appl. Publ. No. 2011/0082055, and Int'l. Publ. No. WO2000018778, both of which are incorporated herein by reference in their entireties.

8. Characterization of Sequence Optimized Nucleic Acids

In some embodiments of the present disclosure, the polynucleotide (e.g., a RNA, e.g., an mRNA) comprising a sequence optimized nucleic acid disclosed herein encoding a CFTR polypeptide can be can be tested to determine whether at least one nucleic acid sequence property (e.g., stability when exposed to nucleases) or expression property has been improved with respect to the non-sequence optimized nucleic acid.

As used herein, "expression property" refers to a property of a nucleic acid sequence either in vivo (e.g., translation efficacy of a synthetic mRNA after administration to a subject in need thereof) or in vitro (e.g., translation efficacy of a synthetic mRNA tested in an in vitro model system). Expression properties include but are not limited to the amount of protein produced by an mRNA encoding a CFTR polypeptide after administration, and the amount of soluble or otherwise functional protein produced. In some embodiments, sequence optimized nucleic acids disclosed herein can be evaluated according to the viability of the cells expressing a protein encoded by a sequence optimized nucleic acid sequence (e.g., a RNA, e.g., an mRNA) encoding a CFTR polypeptide disclosed herein.

In a particular embodiment, a plurality of sequence optimized nucleic acids disclosed herein (e.g., a RNA, e.g., an mRNA) containing codon substitutions with respect to the non-optimized reference nucleic acid sequence can be characterized functionally to measure a property of interest, for example an expression property in an in vitro model system, or in vivo in a target tissue or cell.

a. Optimization of Nucleic Acid Sequence Intrinsic Properties

In some embodiments of the present disclosure, the desired property of the polynucleotide is an intrinsic property of the nucleic acid sequence. For example, the nucleotide sequence (e.g., a RNA, e.g., an mRNA) can be sequence optimized for in vivo or in vitro stability. In some embodiments, the nucleotide sequence can be sequence optimized for expression in a particular target tissue or cell. In some embodiments, the nucleic acid sequence is sequence optimized to increase its plasma half by preventing its degradation by endo and exonucleases.

In other embodiments, the nucleic acid sequence is sequence optimized to increase its resistance to hydrolysis in solution, for example, to lengthen the time that the sequence optimized nucleic acid or a pharmaceutical composition comprising the sequence optimized nucleic acid can be stored under aqueous conditions with minimal degradation.

In other embodiments, the sequence optimized nucleic acid can be optimized to increase its resistance to hydrolysis in dry storage conditions, for example, to lengthen the time that the sequence optimized nucleic acid can be stored after lyophilization with minimal degradation.

b. Nucleic Acids Sequence Optimized for Protein Expression

In some embodiments of the present disclosure, the desired property of the polynucleotide is the level of expression of a CFTR polypeptide encoded by a sequence optimized sequence disclosed herein. Protein expression levels can be measured using one or more expression systems. In some embodiments, expression can be measured in cell culture systems, e.g., CHO cells or HEK293 cells. In some embodiments, expression can be measured using in vitro expression systems prepared from extracts of living cells, e.g., rabbit reticulocyte lysates, or in vitro expression systems prepared by assembly of purified individual components. In other embodiments, the protein expression is measured in an in vivo system, e.g., mouse, rabbit, monkey, etc.

In some embodiments, protein expression in solution form can be desirable. Accordingly, in some embodiments, a reference sequence can be sequence optimized to yield a sequence optimized nucleic acid sequence having optimized levels of expressed proteins in soluble form. Levels of protein expression and other properties such as solubility, levels of aggregation, and the presence of truncation products (i.e., fragments due to proteolysis, hydrolysis, or defective translation) can be measured according to methods known in the art, for example, using electrophoresis (e.g., native or SDS-PAGE) or chromatographic methods (e.g., HPLC, size exclusion chromatography, etc.).

c. Optimization of Target Tissue or Target Cell Viability

In some embodiments, the expression of heterologous therapeutic proteins encoded by a nucleic acid sequence can have deleterious effects in the target tissue or cell, reducing protein yield, or reducing the quality of the expressed product (e.g., due to the presence of protein fragments or precipitation of the expressed protein in inclusion bodies), or causing toxicity.

Accordingly, in some embodiments of the present disclosure, the sequence optimization of a nucleic acid sequence disclosed herein, e.g., a nucleic acid sequence encoding a CFTR polypeptide, can be used to increase the viability of target cells expressing the protein encoded by the sequence optimized nucleic acid.

Heterologous protein expression can also be deleterious to cells transfected with a nucleic acid sequence for autologous or heterologous transplantation. Accordingly, in some embodiments of the present disclosure the sequence optimization of a nucleic acid sequence disclosed herein can be used to increase the viability of target cells expressing the protein encoded by the sequence optimized nucleic acid sequence. Changes in cell or tissue viability, toxicity, and other physiological reaction can be measured according to methods known in the art.

d. Reduction of Immune and/or Inflammatory Response

In some cases, the administration of a sequence optimized nucleic acid encoding CFTR polypeptide or a functional fragment thereof can trigger an immune response, which could be caused by (i) the therapeutic agent (e.g., an mRNA encoding a CFTR polypeptide), or (ii) the expression product of such therapeutic agent (e.g., the CFTR polypeptide encoded by the mRNA), or (iv) a combination thereof. Accordingly, in some embodiments of the present disclosure the sequence optimization of nucleic acid sequence (e.g., an mRNA) disclosed herein can be used to decrease an immune or inflammatory response triggered by the administration of a nucleic acid encoding a CFTR polypeptide or by the expression product of CFTR encoded by such nucleic acid.

In some aspects, an inflammatory response can be measured by detecting increased levels of one or more inflammatory cytokines using methods known in the art, e.g., ELISA. The term "inflammatory cytokine" refers to cytokines that are elevated in an inflammatory response. Examples of inflammatory cytokines include interleukin-6 (IL-6), CXCL1 (chemokine (C-X-C motif) ligand 1; also known as GROα, interferon-γ (IFNγ), tumor necrosis factor α (TNFα), interferon γ-induced protein 10 (IP-10), or granulocyte-colony stimulating factor (G-CSF). The term inflammatory cytokines includes also other cytokines associated with inflammatory responses known in the art, e.g., interleukin-1 (IL-1), interleukin-8 (IL-8), interleukin-12 (IL-12), interleukin-13 (I1-13), interferon α (IFN-α), etc.

9. Modified Nucleotide Sequences Encoding CFTR Polypeptides

In some embodiments, the polynucleotide (e.g., a RNA, e.g., an mRNA) of the present disclosure comprises a chemically modified nucleobase, e.g., 5-methoxyuracil. In some embodiments, the mRNA is a uracil-modified sequence comprising an ORF encoding a CFTR polypeptide, wherein the mRNA comprises a chemically modified nucleobase, e.g., 5-methoxyuracil.

In certain aspects of the present disclosure, when the 5-methoxyuracil base is connected to a ribose sugar, as it is in polynucleotides, the resulting modified nucleoside or nucleotide is refered to as 5-methoxyuridine. In some embodiments, uracil in the polynucleotide is at least about 25%, at least about 30%, at least about 40%, at least about 50%, at least about 60%, at least about 70%, at least about 80%, at least 90%, at least 95%, at least 99%, or about 100% 5-methoxyuracil. In one embodiment, uracil in the polynucleotide is at least 95% 5-methoxyuracil. In another embodiment, uracil in the polynucleotide is 100% 5-methoxyuracil.

In embodiments where uracil in the polynucleotide is at least 95% 5-methoxyuracil, overall uracil content can be adjusted such that an mRNA provides suitable protein expression levels while inducing little to no immune response. In some embodiments, the uracil content of the ORF is between about 105% and about 145%, about 105% and about 140%, about 110% and about 140%, about 110% and about 145%, about 115% and about 135%, about 105% and about 135%, about 110% and about 135%, about 115% and about 145%, or about 115% and about 140% of the theoretical minimum uracil content in the corresponding wild-type ORF (% $U_{TM}$). In other embodiments, the uracil content of the ORF is between about 117% and about 134% or between 118% and 132% of the % $U_{TM}$. In some embodiments, the uracil content of the ORF encoding a CFTR polypeptide is about 115%, about 119%, about 120%, about 125%, about 126%, about 130%, about 135%, about 140%, about 145%, or about 150% of the % $U_{TM}$. In this context, the term "uracil" can refer to 5-methoxyuracil and/or naturally occurring uracil.

In some embodiments, the uracil content in the ORF of the mRNA encoding a CFTR polypeptide of the present disclosure is less than about 50%, about 40%, about 30%, or about 20% of the total nucleobase content in the ORF. In some embodiments, the uracil content in the ORF is between about 15% and about 25% of the total nucleobase content in the ORF. In other embodiments, the uracil content in the ORF is between about 20% and about 30% of the total nuclebase content in the ORF. In one embodiment, the uracil content in the ORF of the mRNA encoding a CFTR polypeptide is less than about 20% of the total nucleobase content in the open reading frame. In this context, the term "uracil" can refer to 5-methoxyuracil and/or naturally occurring uracil.

In further embodiments, the ORF of the mRNA encoding a CFTR polypeptide having 5-methoxyuracil and adjusted uracil content has increased Cytosine (C), Guanine (G), or Guanine/Cytosine (G/C) content (absolute or relative). In some embodiments, the overall increase in C, G, or G/C content (absolute or relative) of the ORF is at least about 2%, at least about 3%, at least about 4%, at least about 5%, at least about 6%, at least about 7%, at least about 10%, at least about 15%, at least about 20%, at least about 40%, at least about 50%, at least about 60%, at least about 70%, at least about 80%, at least about 90%, at least about 95%, or at least about 100% relative to the G/C content (absolute or relative) of the wild-type ORF. In some embodiments, the G, the C, or the G/C content in the ORF is less than about 100%, less than about 90%, less than about 85%, or less than about 80% of the theoretical maximum G, C, or G/C content of the corresponding wild type nucleotide sequence encoding the CFTR polypeptide (% $G_{TMX}$; % $G_{TMX}$, or % $G/C_{TMX}$). In other embodiments, the G, the C, or the G/C content in the ORF is between about 70% and about 80%, between about 71% and about 79%, between about 71% and about 78%, or between about 71% and about 77% of the % $G_{TMX}$, % $C_{TMX}$, or % $G/C_{TMX}$. In some embodiments, the increases in G and/or C content (absolute or relative) described herein can be conducted by replacing synonymous codons with low G, C, or G/C content with synonymous codons having higher G, C, or G/C content. In other embodiments, the increase in G and/or C content (absolute or relative) is conducted by replacing a codon ending with U with a synonymous codon ending with G or C.

In further embodiments, the ORF of the mRNA encoding a CFTR polypeptide of the present disclosure comprises 5-methoxyuracil and has an adjusted uracil content containing less uracil pairs (UU) and/or uracil triplets (UUU) and/or uracil quadruplets (UUUU) than the corresponding wild-type nucleotide sequence encoding the CFTR polypeptide. In some embodiments, the ORF of the mRNA encoding a CFTR polypeptide of the present disclosure contains no uracil pairs and/or uracil triplets and/or uracil quadruplets. In some embodiments, uracil pairs and/or uracil triplets and/or uracil quadruplets are reduced below a certain threshold, e.g., no more than 1, 2, 3, 4, 5, 6, 7, 8, 9, 10, 11, 12, 13, 14, 15, 16, 17, 18, 19, or 20 occurrences in the ORF of the mRNA encoding the CFTR polypeptide. In a particular embodiment, the ORF of the mRNA encoding the CFTR polypeptide of the present disclosure contains less than 20, 19, 18, 17, 16, 15, 14, 13, 12, 11, 10, 9, 8, 7, 6, 5, 4, 3, 2, or 1 non-phenylalanine uracil pairs and/or triplets. In another embodiment, the ORF of the mRNA encoding the CFTR polypeptide contains no non-phenylalanine uracil pairs and/or triplets.

In further embodiments, the ORF of the mRNA encoding a CFTR polypeptide of the present disclosure comprises 5-methoxyuracil and has an adjusted uracil content containing less uracil-rich clusters than the corresponding wild-type nucleotide sequence encoding the CFTR polypeptide. In some embodiments, the ORF of the mRNA encoding the CFTR polypeptide of the present disclosure contains uracil-rich clusters that are shorter in length than corresponding uracil-rich clusters in the corresponding wild-type nucleotide sequence encoding the CFTR polypeptide.

In further embodiments, alternative lower frequency codons are employed. At least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99%, or 100% of the codons in the CFTR polypeptide-encoding ORF of the 5-methoxyuracil-comprising mRNA are substituted with alternative codons, each alternative codon having a codon frequency lower than the codon frequency of the substituted codon in the synonymous codon set. The ORF also has adjusted uracil content, as described above. In some embodiments, at least one codon in the ORF of the mRNA encoding the CFTR polypeptide is substituted with an alternative codon having a codon frequency lower than the codon frequency of the substituted codon in the synonymous codon set.

In some embodiments, the adjusted uracil content, CFTR polypeptide-encoding ORF of the 5-methoxyuracil-comprising mRNA exhibits expression levels of CFTR when administered to a mammalian cell that are higher than expression levels of CFTR from the corresponding wild-type mRNA. In other embodiments, the expression levels of CFTR when administered to a mammalian cell are increased relative to a corresponding mRNA containing at least 95% 5-methoxyuracil and having a uracil content of about 160%, about 170%, about 180%, about 190%, or about 200% of the theoretical minimum. In yet other embodiments, the expression levels of CFTR when administered to a mammalian cell are increased relative to a corresponding mRNA, wherein at least about 50%, at least about 60%, at least about 70%, at least about 80%, at least about 90%, or about 100% of uracils are 1-methylpseudouracil or pseudouracils. In some embodiments, the mammalian cell is a mouse cell, a rat cell, or a rabbit cell. In other embodiments, the mammalian cell is a monkey cell or a human cell. In some embodiments, the human cell is a HeLa cell, a BJ fibroblast cell, or a peripheral blood mononuclear cell (PBMC). In some embodiments, CFTR is expressed when the mRNA is administered to a mammalian cell in vivo. In some embodiments, the mRNA is administered to mice, rabbits, rats, monkeys, or humans. In one embodiment, mice are null mice. In some embodiments, the mRNA is administered to mice in an amount of about 0.01 mg/kg, about 0.05 mg/kg, about 0.1 mg/kg, or about 0.15 mg/kg. In some embodiments, the mRNA is administered intravenously or intramuscularly. In other embodiments, the CFTR polypeptide is expressed when the mRNA is administered to a mammalian cell in vitro. In some embodiments, the expression is increased by at least about 2-fold, at least about 5-fold, at least about 10-fold, at least about 50-fold, at least about 500-fold, at least about 1500-fold, or at least about 3000-fold. In other embodiments, the expression is increased by at least about 10%, about 20%, about 30%, about 40%, about 50%, 60%, about 70%, about 80%, about 90%, or about 100%.

In some embodiments, adjusted uracil content, CFTR polypeptide-encoding ORF of the 5-methoxyuracil-comprising mRNA exhibits increased stability. In some embodiments, the mRNA exhibits increased stability in a cell relative to the stability of a corresponding wild-type mRNA under the same conditions. In some embodiments, the mRNA exhibits increased stability including resistance to nucleases, thermal stability, and/or increased stabilization of secondary structure. In some embodiments, increased stability exhibited by the mRNA is measured by determining the half-life of the mRNA (e.g., in a plasma, cell, or tissue sample) and/or determining the area under the curve (AUC) of the protein expression by the mRNA over time (e.g., in vitro or in vivo). An mRNA is identified as having increased stability if the half-life and/or the AUC is greater than the half-life and/or the AUC of a corresponding wild-type mRNA under the same conditions.

In some embodiments, the mRNA of the present disclosure induces a detectably lower immune response (e.g., innate or acquired) relative to the immune response induced by a corresponding wild-type mRNA under the same conditions. In other embodiments, the mRNA of the present disclosure induces a detectably lower immune response (e.g., innate or acquired) relative to the immune response induced by an mRNA that encodes for a CFTR polypeptide but does not comprise 5-methoxyuracil under the same conditions, or relative to the immune response induced by an mRNA that encodes for a CFTR polypeptide and that comprises 5-methoxyuracil but that does not have adjusted uracil content under the same conditions. The innate immune response can be manifested by increased expression of pro-inflammatory cytokines, activation of intracellular PRRs (RIG-I, MDA5, etc), cell death, and/or termination or reduction in protein translation. In some embodiments, a reduction in the innate immune response can be measured by expression or activity level of Type 1 interferons (e.g., IFN-α, IFN-β, IFN-κ, IFN-δ, IFN-ε, IFN-τ, IFN-ω, and IFN-ζ or the expression of interferon-regulated genes such as the toll-like receptors (e.g., TLR7 and TLR8), and/or by decreased cell death following one or more administrations of the mRNA of the present disclosure into a cell.

In some embodiments, the expression of Type-1 interferons by a mammalian cell in response to the mRNA of the present disclosure is reduced by at least 10%, 20%, 30%, 40%, 50%, 60%, 70%, 80%, 90%, 95%, 99%, 99.9%, or greater than 99.9% relative to a corresponding wild-type mRNA, to an mRNA that encodes a CFTR polypeptide but does not comprise 5-methoxyuracil, or to an mRNA that encodes a CFTR polypeptide and that comprises 5-methoxyuracil but that does not have adjusted uracil content. In some embodiments, the interferon is IFN-β. In some embodiments, cell death frequency cased by administration of mRNA of the present disclosure to a mammalian cell is 10%, 25%, 50%, 75%, 85%, 90%, 95%, or over 95% less than the cell death frequency observed with a corresponding wild-type mRNA, an mRNA that encodes for a CFTR polypeptide but does not comprise 5-methoxyuracil, or an mRNA that encodes for a CFTR polypeptide and that comprises 5-methoxyuracil but that does not have adjusted uracil content. In some embodiments, the mammalian cell is a BJ fibroblast cell. In other embodiments, the mammalian cell is a splenocyte. In some embodiments, the mammalian cell is that of a mouse or a rat. In other embodiments, the mammalian cell is that of a human. In one embodiment, the mRNA of the present disclosure does not substantially induce an innate immune response of a mammalian cell into which the mRNA is introduced.

In some embodiments, the polynucleotide is an mRNA that comprises an ORF that encodes a CFTR polypeptide, wherein uracil in the mRNA is at least about 95% 5-methoxyuracil, wherein the uracil content of the ORF is between about 115% and about 135% of the theoretical minimum uracil content in the corresponding wild-type ORF, and wherein the uracil content in the ORF encoding the CFTR polypeptide is less than about 30% of the total nucleobase content in the ORF. In some embodiments, the ORF that encodes the CFTR polypeptide is further modified to increase G/C content of the ORF (absolute or relative) by at least about 40%, as compared to the corresponding wild-type ORF. In yet other embodiments, the ORF encoding the CFTR polypeptide contains less than 20 non-phenylalanine uracil pairs and/or triplets. In some embodiments, at least one codon in the ORF of the mRNA encoding the CFTR polypeptide is further substituted with an alternative codon having a codon frequency lower than the codon frequency of the substituted codon in the synonymous codon set. In some embodiments, the expression of the CFTR polypeptide encoded by an mRNA comprsing an ORF wherein uracil in the mRNA is at least about 95% 5-methoxyuracil, and wherein the uracil content of the ORF is between about 115% and about 135% of the theoretical minimum uracil content in the corresponding wild-type ORF, is increased by at least about 10-fold when compared to expression of the CFTR polypeptide from the corresponding wild-type mRNA. In some embodiments, the mRNA comprises an open ORF wherein uracil in the mRNA is at least about 95% 5-methoxyuracil, and wherein the uracil content of the ORF is between about 115% and about 135% of the theoretical minimum uracil content in the corresponding wild-type ORF, and wherein the mRNA does not substantially induce an innate immune response of a mammalian cell into which the mRNA is introduced.

10. Methods for Modifying Polynucleotides

The present disclosure includes modified polynucleotides comprising a polynucleotide described herein (e.g., a polynucleotide comprising a nucleotide sequence encoding a CFTR polypeptide). The modified polynucleotides can be chemically modified and/or structurally modified. When the polynucleotides of the present disclosure are chemically and/or structurally modified the polynucleotides can be referred to as "modified polynucleotides."

The present disclosure provides for modified nucleosides and nucleotides of a polynucleotide (e.g., RNA polynucleotides, such as mRNA polynucleotides) encoding a CFTR polypeptide. A "nucleoside" refers to a compound containing a sugar molecule (e.g., a pentose or ribose) or a derivative thereof in combination with an organic base (e.g., a purine or pyrimidine) or a derivative thereof (also referred to herein as "nucleobase"). A "nucleotide" refers to a nucleoside including a phosphate group. Modified nucleotides can by synthesized by any useful method, such as, for example, chemically, enzymatically, or recombinantly, to include one or more modified or non-natural nucleosides. Polynucleotides can comprise a region or regions of linked nucleosides. Such regions can have variable backbone linkages. The linkages can be standard phosphodiester linkages, in which case the polynucleotides would comprise regions of nucleotides.

The modified polynucleotides disclosed herein can comprise various distinct modifications. In some embodiments, the modified polynucleotides contain one, two, or more (optionally different) nucleoside or nucleotide modifications. In some embodiments, a modified polynucleotide, introduced to a cell can exhibit one or more desirable properties, e.g., improved protein expression, reduced immunogenicity, or reduced degradation in the cell, as compared to an unmodified polynucleotide.

a. Structural Modifications

In some embodiments, a polynucleotide of the present disclosure (e.g., a polynucleotide comprising a nucleotide sequence encoding a CFTR polypeptide) is structurally modified. As used herein, a "structural" modification is one in which two or more linked nucleosides are inserted, deleted, duplicated, inverted or randomized in a polynucleotide without significant chemical modification to the nucleotides themselves. Because chemical bonds will necessarily be broken and reformed to effect a structural modification, structural modifications are of a chemical nature and hence are chemical modifications. However, structural modifications will result in a different sequence of nucleotides. For example, the polynucleotide "ATCG" can be chemically modified to "AT-5meC-G". The same polynucleotide can be structurally modified from "ATCG" to "ATCCG". Here, the dinucleotide "CC" has been inserted, resulting in a structural modification to the polynucleotide.

b. Chemical Modifications

In some embodiments, the polynucleotides of the present disclosure are chemically modified. As used herein in reference to a polynucleotide, the terms "chemical modification" or, as appropriate, "chemically modified" refer to modification with respect to adenosine (A), guanosine (G), uridine (U), thymidine (T) or cytidine (C) ribo- or deoxyribonucleosides in one or more of their position, pattern, percent or population. Generally, herein, these terms are not intended to refer to the ribonucleotide modifications in naturally occurring 5'-terminal mRNA cap moieties.

In some embodiments, the polynucleotides of the present disclosure can have a uniform chemical modification of all or any of the same nucleoside type or a population of modifications produced by mere downward titration of the same starting modification in all or any of the same nucleoside type, or a measured percent of a chemical modification of all any of the same nucleoside type but with random incorporation, such as where all uridines are replaced by a uridine analog, e.g., pseudouridine or 5-methoxyuridine. In another embodiment, the polynucleotides can have a uniform chemical modification of two, three, or four of the same nucleoside type throughout the entire polynucleotide (such as all uridines and all cytosines, etc. are modified in the same way).

Modified nucleotide base pairing encompasses not only the standard adenosine-thymine, adenosine-uracil, or guanosine-cytosine base pairs, but also base pairs formed between nucleotides and/or modified nucleotides comprising non-standard or modified bases, wherein the arrangement of hydrogen bond donors and hydrogen bond acceptors permits hydrogen bonding between a non-standard base and a standard base or between two complementary non-standard base structures. One example of such non-standard base pairing is the base pairing between the modified nucleotide inosine and adenine, cytosine or uracil. Any combination of base/sugar or linker can be incorporated into polynucleotides of the present disclosure.

The skilled artisan will appreciate that, except where otherwise noted, polynucleotide sequences set forth in the instant application will recite "T"s in a representative DNA sequence but where the sequence represents RNA, the "T"s would be substituted for "U"s.

Modifications of polynucleotides (e.g., RNA polynucleotides, such as mRNA polynucleotides) that are useful in the compositions, methods and synthetic processes of the present disclosure include, but are not limited to the following nucleotides, nucleosides, and nucleobases: 2-methylthio-N6-(cis-hydroxyisopentenyl)adenosine; 2-methylthio-N6-methyladenosine; 2-methylthio-N6-threonyl carbamoyladenosine; N6-glycinylcarbamoyladenosine; N6-isopentenyladenosine; N6-methyladenosine; N6-threonylcarbamoyladenosine; 1,2'-O-dimethyladenosine; 1-methyladenosine; 2'-O-methyladenosine; 2'-O-ribosyladenosine (phosphate); 2-methyladenosine; 2-methylthio-N6 isopentenyladenosine; 2-methylthio-N6-hydroxynorvalyl carbamoyladenosine; 2'-O-methyladenosine; 2'-O-ribosyladenosine (phosphate); Isopentenyladenosine; N6-(cis-hydroxyisopentenyl)adenosine; N6,2'-O-dimethyladenosine; N6,2'-O-dimethyladenosine; N6,N6,2'-O-trimethyladenosine; N6,N6-dimethyladenosine; N6-acetyladenosine; N6-hydroxynorvalylcarbamoyladenosine; N6-methyl-N6-threonylcarbamoyladenosine; 2-methyladenosine; 2-methylthio-N6-isopentenyladenosine; 7-deaza-adenosine; N1-methyl-adenosine; N6, N6 (dimethyl)adenine; N6-cis-hydroxy-isopentenyl-adenosine; α-thio-adenosine; 2 (amino)adenine; 2 (aminopropyl)adenine; 2 (methylthio) N6 (isopentenyl)adenine; 2-(alkyl)adenine; 2-(aminoalkyl)adenine; 2-(aminopropyl)adenine; 2-(halo)adenine; 2-(halo) adenine; 2-(propyl)adenine; 2'-Amino-2'-deoxy-ATP; 2'-Azido-2'-deoxy-ATP; 2'-Deoxy-2'-α-aminoadenosine TP; 2'-Deoxy-2'-α-azidoadenosine TP; 6 (alkyl)adenine; 6 (methyl)adenine; 6-(alkyl)adenine; 6-(methyl)adenine; 7 (deaza)adenine; 8 (alkenyl)adenine; 8 (alkynyl)adenine; 8 (amino)adenine; 8 (thioalkyl)adenine; 8-(alkenyl)adenine; 8-(alkyl)adenine; 8-(alkynyl)adenine; 8-(amino)adenine; 8-(halo)adenine; 8-(hydroxyl)adenine; 8-(thioalkyl)adenine; 8-(thiol)adenine; 8-azido-adenosine; aza adenine; deaza adenine; N6 (methyl)adenine; N6-(isopentyl)adenine; 7-deaza-8-aza-adenosine; 7-methyladenine; 1-Deazaadenosine TP; 2'Fluoro-N6-Bz-deoxyadenosine TP; 2'-OMe-2-Amino-ATP; 2'O-methyl-N6-Bz-deoxyadenosine TP; 2'-a-Ethynyladenosine TP; 2-aminoadenine; 2-Aminoadenosine TP; 2-Amino-ATP; 2'-a-Trifluoromethyladenosine TP; 2-Azidoadenosine TP; 2'-b-Ethynyladenosine TP; 2-Bromoadenosine TP; 2'-b-Trifluoromethyladenosine TP; 2-Chloroadenosine TP; 2'-Deoxy-2',2'-difluoroadenosine TP; 2'-Deoxy-2'-a-mercaptoadenosine TP; 2'-Deoxy-2'-a-thiomethoxyadenosine TP; 2'-Deoxy-2'-b-aminoadenosine TP; 2'-Deoxy-2'-b-azidoadenosine TP; 2'-Deoxy-2'-b-bromoadenosine TP; 2'-Deoxy-2'-b-chloroadenosine TP; 2'-Deoxy-2'-b-fluoroadenosine TP; 2'-Deoxy-2'-b-iodoadenosine TP; 2'-Deoxy-2'-b-mercaptoadenosine TP; 2'-Deoxy-2'-b-thiomethoxyadenosine TP; 2-Fluoroadenosine TP; 2-Iodoadenosine TP; 2-Mercaptoadenosine TP; 2-methoxy-adenine; 2-methylthio-adenine; 2-Trifluoromethyladenosine TP; 3-Deaza-3-bromoadenosine TP; 3-Deaza-3-chloroadenosine TP; 3-Deaza-3-fluoroadenosine TP; 3-Deaza-3-iodoadenosine TP; 3-Deazaadenosine TP; 4'-Azidoadenosine TP; 4'-Carbocyclic adenosine TP; 4'-Ethynyladenosine TP; 5'-Homo-adenosine TP; 8-Aza-ATP; 8-bromo-adenosine TP; 8-Trifluoromethyladenosine TP; 9-Deazaadenosine TP; 2-aminopurine; 7-deaza-2,6-diaminopurine; 7-deaza-8-aza-2,6-diaminopurine; 7-deaza-8-aza-2-aminopurine; 2,6-diaminopurine; 7-deaza-8-aza-adenine, 7-deaza-2-aminopurine; 2-thiocytidine; 3-methylcytidine; 5-formylcytidine; 5-hydroxymethylcytidine; 5-methylcytidine; N4-acetylcytidine; 2'-O-methylcytidine; 2'-O-methylcytidine; 5,2'-O-dimethylcytidine; 5-formyl-2'-O-methylcytidine; Lysidine; N4,2'-O-dimethylcytidine; N4-acetyl-2'-O-methylcytidine; N4-methylcytidine; N4,N4-Dimethyl-2'-OMe-Cytidine TP; 4-methylcytidine; 5-aza-cytidine; Pseudo-iso-cytidine; pyrrolo-cytidine; α-thio-cytidine; 2-(thio)cytosine; 2'-Amino-2'-deoxy-CTP; 2'-Azido-2'-deoxy-CTP; 2'-Deoxy-2'-α-aminocytidine TP; 2'-Deoxy-2'-α-azidocytidine TP; 3 (deaza) 5 (aza)cytosine; 3 (methyl)cytosine; 3-(alkyl)cytosine; 3-(deaza) 5 (aza)cytosine; 3-(methyl)cytidine; 4,2'-O-dimethylcytidine; 5 (halo)cytosine; 5 (methyl)cytosine; 5 (propynyl)cytosine; 5 (trifluoromethyl)cytosine; 5-(alkyl)cytosine; 5-(alkynyl)cytosine; 5-(halo)cytosine; 5-(propynyl)cytosine; 5-(trifluoromethyl)cytosine; 5-bromo-cytidine; 5-iodo-cytidine; 5-propynyl cytosine; 6-(azo)cytosine; 6-aza-cytidine; aza cytosine; deaza cytosine; N4 (acetyl) cytosine; 1-methyl-1-deaza-pseudoisocytidine; 1-methyl-pseudoisocytidine; 2-methoxy-5-methyl-cytidine; 2-methoxy-cytidine; 2-thio-5-methyl-cytidine; 4-methoxy-1-methyl-pseudoisocytidine; 4-methoxy-pseudoisocytidine; 4-thio-1-methyl-1-deaza-pseudoisocytidine; 4-thio-1-methyl-pseudoisocytidine; 4-thio-pseudoisocytidine; 5-aza-zebularine; 5-methyl-zebularine; pyrrolo-pseudoisocytidine; Zebularine; (E)-5-(2-Bromo-vinyl)cytidine TP; 2,2'-anhydro-cytidine TP hydrochloride; 2'Fluor-N4-Bz-cytidine TP; 2'Fluoro-N4-Acetyl-cytidine TP; 2'-O-Methyl-N4-Acetyl-cytidine TP; 2'O-methyl-N4-Bz-cytidine TP; 2'-a-Ethynylcytidine TP; 2'-a-Trifluoromethylcytidine TP; 2'-b-Ethynylcytidine TP; 2'-b-Trifluoromethylcytidine TP; 2'-Deoxy-2',2'-difluorocytidine TP; 2'-Deoxy-2'-a-mercaptocytidine TP; 2'-Deoxy-2'-a-thiomethoxycytidine TP; 2'-Deoxy-2'-b-aminocytidine TP; 2'-Deoxy-2'-b-azidocytidine TP; 2'-Deoxy-2'-b-bromocytidine TP; 2'-Deoxy-2'-b-chlorocytidine TP; 2'-Deoxy-2'-b-fluorocytidine TP; 2'-Deoxy-2'-b-iodocytidine TP; 2'-Deoxy-2'-b-mercaptocytidine TP; 2'-Deoxy-2'-b-thiomethoxycytidine TP; 2'-O-Methyl-5-(1-propynyl)cytidine TP; 3'-Ethynylcytidine TP; 4'-Azidocytidine TP; 4'-Carbocyclic cytidine TP; 4'-Ethynylcytidine TP; 5-(1-Propynyl)ara-cytidine TP; 5-(2-Chloro-phenyl)-2-thiocytidine TP; 5-(4-Amino-phenyl)-2-thiocytidine TP; 5-Aminoallyl-CTP; 5-Cyanocytidine TP; 5-Ethynylara-cytidine TP; 5-Ethynylcytidine TP; 5'-Homo-cytidine TP; 5-Methoxycytidine TP; 5-Trifluoromethyl-Cytidine TP; N4-Amino-cytidine TP; N4-Benzoyl-cytidine TP; Pseudoisocytidine; 7-methylguanosine; N2,2'-O-dimethylguanosine; N2-methylguanosine; Wyosine; 1,2'-O-dimethyl-guanosine; 1-methylguanosine; 2'-O-methylguanosine; 2'-O-ribosylguanosine (phosphate); 2'-O-methylguanosine; 2'-O-ribosylguanosine (phosphate); 7-aminomethyl-7-deazaguanosine; 7-cyano-7-deazaguanosine; Archaeosine; Methylwyosine; N2,7-dimethylguanosine; N2,N2,2'-O-trimethylguanosine; N2,N2,7-trimethylguanosine; N2,N2-dimethylguanosine; N2,7,2'-O-trimethylguanosine; 6-thio-guanosine; 7-deaza-guanosine; 8-oxo-guanosine; N1-methyl-guanosine; α-thio-guanosine; 2 (propyl)guanine; 2-(alkyl)guanine; 2'-Amino-2'-deoxy-GTP; 2'-Azido-2'-deoxy-GTP; 2'-Deoxy-2'-α-aminoguanosine TP; 2'-Deoxy-2'-α-azidoguanosine TP; 6 (methyl)guanine; 6-(alkyl)guanine; 6-(methyl)guanine; 6-methyl-guanosine; 7 (alkyl)guanine; 7 (deaza)guanine; 7 (methyl)guanine; 7-(alkyl)guanine; 7-(deaza)guanine; 7-(methyl)guanine; 8 (alkyl)guanine; 8 (alkynyl)guanine; 8 (halo)guanine; 8 (thioalkyl)guanine; 8-(alkenyl)guanine; 8-(alkyl)guanine; 8-(alkynyl)guanine; 8-(amino)guanine; 8-(halo)guanine; 8-(hydroxyl)guanine; 8-(thioalkyl)guanine; 8-(thiol)guanine; aza guanine; deaza guanine; N (methyl)guanine; N-(methyl)guanine; 1-methyl-6-thio-guanosine; 6-methoxy-guanosine; 6-thio-7-deaza-8-aza-guanosine; 6-thio-7-deaza-guanosine; 6-thio-7-methyl-guanosine; 7-deaza-8-aza-guanosine; 7-methyl-8-oxo-guanosine; N2,N2-dimethyl-6-thio-guanosine; N2-methyl-6-thio-guanosine; 1-Me-GTP; 2'Fluoro-N2-isobutyl-guanosine TP; 2'O-methyl-N2-isobutyl-guanosine TP; 2'-a-Ethynylguanosine TP; 2'-a-Trifluoromethylguanosine TP; 2'-b-Ethynylguanosine TP; 2'-b-Trifluoromethylguanosine TP; 2'-Deoxy-2',2'-difluoroguanosine TP; 2'-Deoxy-2'-a-mercaptoguanosine TP; 2'-Deoxy-2'-a-thiomethoxyguanosine TP; 2'-Deoxy-2'-b-aminoguanosine TP; 2'-Deoxy-2'-b-azidoguanosine TP; 2'-Deoxy-2'-b-bromoguanosine TP; 2'-Deoxy-2'-b-chloroguanosine TP; 2'-Deoxy-2'-b-fluoroguanosine TP; 2'-Deoxy-2'-b-iodoguanosine TP; 2'-Deoxy-2'-b-mercaptoguanosine TP; 2'-Deoxy-2'-b-thiomethoxyguanosine TP; 4'-Azidoguanosine TP; 4'-Carbocyclic guanosine TP; 4'-Ethynylguanosine TP; 5'-Homo-guanosine TP; 8-bromo-guanosine TP; 9-Deazaguanosine TP; N2-isobutyl-guanosine TP; 1-methylinosine; Inosine; 1,2'-O-dimethylinosine; 2'-O-methylinosine; 7-methylinosine; 2'-O-methylinosine; Epoxyqueuosine; galactosyl-queuosine; Mannosylqueuosine; Queuosine; allyamino-thymidine; aza thymidine; deaza thymidine; deoxy-thymidine; 2'-O-methyluridine; 2-thiouridine; 3-methyluridine; 5-carboxymethyluridine; 5-hydroxyuridine; 5-methyluridine; 5-taurinomethyl-2-thiouridine; 5-taurinomethyluridine; Dihydrouridine; Pseudouridine; (3-(3-amino-3-carboxypropyl)uridine; 1-methyl-3-(3-amino-5-carboxypropyl)pseudouridine; 1-methylpseduouridine; 1-ethyl-pseudouridine; 2'-O-methyluridine; 2'-O-methylpseudouridine; 2'-O-methyluridine; 2-thio-2'-O-methyluridine; 3-(3-amino-3-carboxypropyl)uridine; 3,2'-O-dimethyluridine; 3-Methyl-pseudo-Uridine TP; 4-thiouridine; 5-(carboxyhydroxymethyl)uridine; 5-(carboxyhydroxymethyl)uridine methyl ester; 5,2'-O-dimethyluridine; 5,6-dihydro-uridine; 5-aminomethyl-2-thiouridine; 5-carbamoyl-methyl-2'-O-methyluridine; 5-carbamoylmethyluridine; 5-carboxyhydroxymethyluridine; 5-carboxyhydroxymethyluridine methyl ester; 5-carboxymethylaminomethyl-2'-O-methyluridine; 5-carboxymethylaminomethyl-2-thiouridine; 5-carboxymethylaminomethyl-2-thiouridine; 5-carboxymethylaminomethyluridine; 5-carboxymethyl-aminomethyluridine; 5-Carbamoylmethyluridine TP; 5-methoxycarbonylmethyl-2'-O-methyluridine; 5-methoxycarbonylmethyl-2-thiouridine; 5-methoxycarbonylmethyluridine; 5-methyluridine,), 5-methoxyuridine; 5-methyl-2-thiouridine; 5-methylaminomethyl-2-selenouridine; 5-methylaminomethyl-2-thiouridine; 5-methylaminomethyluridine; 5-Methyldihydrouridine; 5-Oxyacetic acid-Uridine TP; 5-Oxyacetic acid-methyl ester-Uridine TP; 1-methyl-pseudo-uracil; N1-ethyl-pseudo-uracil; uridine 5-oxyacetic acid; uridine 5-oxyacetic acid methyl ester; 3-(3-Amino-3-carboxypropyl)-Uridine TP; 5-(iso-Pentenylaminomethyl)-

2-thiouridine TP; 5-(iso-Pentenylaminomethyl)-2'-O-methyluridine TP; 5-(iso-Pentenylaminomethyl)uridine TP; 5-propynyl uracil; α-thio-uridine; 1 (aminoalkylamino-carbonylethylenyl)-2(thio)-pseudouracil; 1 (aminoalkylaminocarbonylethylenyl)-2,4-(dithio)pseudouracil; 1 (aminoalkylaminocarbonylethylenyl)-4 (thio)pseudouracil; 1 (aminoalkylaminocarbonylethylenyl)-pseudouracil; 1 (aminocarbonylethylenyl)-2(thio)-pseudouracil; 1 (aminocarbonylethylenyl)-2,4-(dithio)pseudouracil; 1 (aminocarbonylethylenyl)-4 (thio)pseudouracil; 1 (aminocarbonylethylenyl)-pseudouracil; 1 substituted 2(thio)-pseudouracil; 1 substituted 2,4-(dithio)pseudouracil; 1 substituted 4 (thio)pseudouracil; 1 substituted pseudouracil; 1-(aminoalkylamino-carbonylethylenyl)-2-(thio)-pseudouracil; 1-Methyl-3-(3-amino-3-carboxypropyl) pseudouridine TP; 1-Methyl-3-(3-amino-3-carboxypropyl) pseudo-UTP; 1-Methyl-pseudo-UTP; 1-Ethyl-pseudo-UTP; 2 (thio)pseudouracil; 2' deoxy uridine; 2' fluorouridine; 2-(thio)uracil; 2,4-(dithio)psuedouracil; 2' methyl, 2'amino, 2'azido, 2'fluro-guanosine; 2'-Amino-2'-deoxy-UTP; 2'-Azido-2'-deoxy-UTP; 2'-Azido-deoxyuridine TP; 2'-O-methylpseudouridine; 2' deoxy uridine; 2' fluorouridine; 2'-Deoxy-2'-a-aminouridine TP; 2'-Deoxy-2'-α-azidouridine TP; 2-methylpseudouridine; 3 (3 amino-3 carboxypropyl) uracil; 4 (thio)pseudouracil; 4-(thio)pseudouracil; 4-(thio) uracil; 4-thiouracil; 5 (1,3-diazole-1-alkyl)uracil; 5 (2-aminopropyl)uracil; 5 (aminoalkyl)uracil; 5 (dimethylaminoalkyl)uracil; 5 (guanidiniumalkyl)uracil; 5 (methoxycarbonylmethyl)-2-(thio)uracil; 5 (methoxycarbonyl-methyl)uracil; 5 (methyl) 2 (thio)uracil; 5 (methyl) 2,4 (dithio)uracil; 5 (methyl) 4 (thio)uracil; 5 (methylaminomethyl)-2 (thio)uracil; 5 (methylaminomethyl)-2,4 (dithio) uracil; 5 (methylaminomethyl)-4 (thio)uracil; 5 (propynyl) uracil; 5 (trifluoromethyl)uracil; 5-(2-aminopropyl)uracil; 5-(alkyl)-2-(thio)pseudouracil; 5-(alkyl)-2,4 (dithio) pseudouracil; 5-(alkyl)-4 (thio)pseudouracil; 5-(alkyl) pseudouracil; 5-(alkyl)uracil; 5-(alkynyl)uracil; 5-(allylamino)uracil; 5-(cyanoalkyl)uracil; 5-(dialkylaminoalkyl) uracil; 5-(dimethylaminoalkyl)uracil; 5-(guanidiniumalkyl) uracil; 5-(halo)uracil; 5-(1,3-diazole-1-alkyl)uracil; 5-(methoxy)uracil; 5-(methoxycarbonylmethyl)-2-(thio) uracil; 5-(methoxycarbonyl-methyl)uracil; 5-(methyl) 2(thio)uracil; 5-(methyl) 2,4 (dithio) uracil; 5-(methyl) 4 (thio)uracil; 5-(methyl)-2-(thio)pseudouracil; 5-(methyl)-2,4 (dithio)pseudouracil; 5-(methyl)-4 (thio)pseudouracil; 5-(methyl)pseudouracil; 5-(methylaminomethyl)-2 (thio)uracil; 5-(methylaminomethyl)-2,4(dithio)uracil; 5-(methylaminomethyl)-4-(thio)uracil; 5-(propynyl)uracil; 5-(trifluoromethyl)uracil; 5-aminoallyl-uridine; 5-bromo-uridine; 5-iodo-uridine; 5-uracil; 6 (azo)uracil; 6-(azo)uracil; 6-aza-uridine; allyamino-uracil; aza uracil; deaza uracil; N3 (methyl)uracil; P seudo-UTP-1-2-ethanoic acid; Pseudouracil; 4-Thio-pseudo-UTP; 1-carboxymethyl-pseudouridine; 1-methyl-1-deaza-pseudouridine; 1-propynyl-uridine; 1-taurinomethyl-1-methyl-uridine; 1-taurinomethyl-4-thio-uridine; 1-taurinomethyl-pseudouridine; 2-methoxy-4-thio-pseudouridine; 2-thio-1-methyl-1-deaza-pseudouridine; 2-thio-1-methyl-pseudouridine; 2-thio-5-aza-uridine; 2-thio-dihydropseudouridine; 2-thio-dihydrouridine; 2-thio-pseudouridine; 4-methoxy-2-thio-pseudouridine; 4-methoxy-pseudouridine; 4-thio-1-methyl-pseudouridine; 4-thio-pseudouridine; 5-aza-uridine; Dihydropseudouridine; (±)1-(2-Hydroxypropyl)pseudouridine TP; (2R)-1-(2-Hydroxypropyl)pseudouridine TP; (2S)-1-(2-Hydroxypropyl) pseudouridine TP; (E)-5-(2-Bromo-vinyl)ara-uridine TP; (E)-5-(2-Bromo-vinyl)uridine TP; (Z)-5-(2-Bromo-vinyl) ara-uridine TP; (Z)-5-(2-Bromo-vinyl)uridine TP; 1-(2,2,2-Trifluoroethyl)-pseudo-UTP; Pentafluoropropyl)pseudouridine TP; 1-(2,2-Diethoxyethyl)pseudouridine TP; 1-(2,4,6-Trimethylbenzyl)pseudouridine TP; 1-(2,4,6-Trimethyl-benzyl)pseudo-UTP; 1-(2,4,6-Trimethyl-phenyl)pseudo-UTP; 1-(2-Amino-2-carboxyethyl)pseudo-UTP; 1-(2-Amino-ethyl)pseudo-UTP; 1-(2-Hydroxyethyl) pseudouridine TP; 1-(2-Methoxyethyl)pseudouridine TP; 1-(3,4-Bis-trifluoromethoxybenzyl)pseudouridine TP; 1-(3, 4-Dimethoxybenzyl)pseudouridine TP; 1-(3-Amino-3-carboxypropyl)pseudo-UTP; 1-(3-Amino-propyl)pseudo-UTP; 1-(3-Cyclopropyl-prop-2-ynyl)pseudouridine TP; 1-(4-Amino-4-carboxybutyl)pseudo-UTP; 1-(4-Amino-benzyl) pseudo-UTP; 1-(4-Amino-butyl)pseudo-UTP; 1-(4-Amino-phenyl)pseudo-UTP; 1-(4-Azidobenzyl)pseudouridine TP; 1-(4-Bromobenzyl)pseudouridine TP; 1-(4-Chlorobenzyl) pseudouridine TP; 1-(4-Fluorobenzyl)pseudouridine TP; 1-(4-Iodobenzyl)pseudouridine TP; 1-(4-Methanesulfonyl-benzyl)pseudouridine TP; 1-(4-Methoxybenzyl)pseudouridine TP; 1-(4-Methoxy-benzyl)pseudo-UTP; 1-(4-Methoxy-phenyl)pseudo-UTP; 1-(4-Methylbenzyl)pseudouridine TP; 1-(4-Methyl-benzyl)pseudo-UTP; 1-(4-Nitrobenzyl) pseudouridine TP; 1-(4-Nitro-benzyl)pseudo-UTP; 1(4-Nitro-phenyl)pseudo-UTP; 1-(4-Thiomethoxybenzyl) pseudouridine TP; 1-(4-Trifluoromethoxybenzyl) pseudouridine TP; 1-(4-Trifluoromethylbenzyl) pseudouridine TP; 1-(5-Amino-pentyl)pseudo-UTP; 1-(6-Amino-hexyl)pseudo-UTP; 1,6-Dimethyl-pseudo-UTP; 1-[3-(2-{2-[2-(2-Aminoethoxy)-ethoxy]-ethoxy}-ethoxy)-propionyl]pseudouridine TP; 1-{3-[2-(2-Aminoethoxy)-ethoxy]-propionyl} pseudouridine TP; 1-Acetylpseudouridine TP; 1-Alkyl-6-(1-propynyl)-pseudo-UTP; 1-Alkyl-6-(2-propynyl)-pseudo-UTP; 1-Alkyl-6-allyl-pseudo-UTP; 1-Alkyl-6-ethynyl-pseudo-UTP; 1-Alkyl-6-homoallyl-pseudo-UTP; 1-Alkyl-6-vinyl-pseudo-UTP; 1-Allylpseudouridine TP; 1-Aminomethyl-pseudo-UTP; 1-Benzoylpseudouridine TP; 1-Benzyloxymethylpseudouridine TP; 1-Benzyl-pseudo-UTP; 1-Biotinyl-PEG2-pseudouridine TP; 1-Biotinylpseudouridine TP; 1-Butyl-pseudo-UTP; 1-Cyanomethylpseudouridine TP; 1-Cyclobutylmethyl-pseudo-UTP; 1-Cyclobutyl-pseudo-UTP; 1-Cycloheptylmethyl-pseudo-UTP; 1-Cycloheptyl-pseudo-UTP; 1-Cyclohexylmethyl-pseudo-UTP; 1-Cyclohexyl-pseudo-UTP; 1-Cyclooctylmethyl-pseudo-UTP; 1-Cyclooctyl-pseudo-UTP; 1-Cyclopentylmethyl-pseudo-UTP; 1-Cyclopentyl-pseudo-UTP; 1-Cyclopropylmethyl-pseudo-UTP; 1-Cyclopropyl-pseudo-UTP; 1-Ethyl-pseudo-UTP; 1-Hexyl-pseudo-UTP; 1-Homoallylpseudouridine TP; 1-Hydroxymethylpseudouridine TP; 1-iso-propyl-pseudo-UTP; 1-Me-2-thio-pseudo-UTP; 1-Me-4-thio-pseudo-UTP; 1-Me-alpha-thio-pseudo-UTP; 1-Methanesulfonylmethylpseudouridine TP; 1-Methoxymethylpseudouridine TP; 1-Methyl-6-(2,2,2-Trifluoroethyl)pseudo-UTP; 1-Methyl-6-(4-morpholino)-pseudo-UTP; 1-Methyl-6-(4-thiomorpholino)-pseudo-UTP; 1-Methyl-6-(substituted phenyl) pseudo-UTP; 1-Methyl-6-amino-pseudo-UTP; 1-Methyl-6-azido-pseudo-UTP; 1-Methyl-6-bromo-pseudo-UTP; 1-Methyl-6-butyl-pseudo-UTP; 1-Methyl-6-chloro-pseudo-UTP; 1-Methyl-6-cyano-pseudo-UTP; 1-Methyl-6-dimethylamino-pseudo-UTP; 1-Methyl-6-ethoxy-pseudo-UTP; 1-Methyl-6-ethylcarboxylate-pseudo-UTP; 1-Methyl-6-ethyl-pseudo-UTP; 1-Methyl-6-fluoro-pseudo-UTP; 1-Methyl-6-formyl-pseudo-UTP; 1-Methyl-6-hydroxyamino-pseudo-UTP; 1-Methyl-6-hydroxy-pseudo-UTP; 1-Methyl-6-iodo-pseudo-UTP; 1-Methyl-6-iso-propyl-pseudo-UTP; 1-Methyl-6-methoxy-pseudo-UTP; 1-Methyl-6-methylamino-pseudo-UTP; 1-Methyl-6-phenyl-pseudo-UTP; 1-Methyl-6-propyl-pseudo-UTP; 1-Methyl-6- tert-butyl-pseudo-UTP; 1-Methyl-6-trifluoromethoxy-pseudo-UTP; 1-Methyl-6-trifluoromethyl-pseudo-UTP; 1-Morpholinomethylpseudouridine TP; 1-Pentyl-pseudo-UTP; 1-Phenyl-pseudo-UTP; 1-Pivaloylpseudouridine TP; 1-Propargylpseudouridine TP; 1-Propyl-pseudo-UTP; 1-propynyl-pseudouridine; 1-p-tolyl-pseudo-UTP; 1-tert-Butyl-pseudo-UTP; 1-Thiomethoxymethylpseudouridine TP; 1-Thiomorpholinomethylpseudouridine TP; 1-Trifluoroacetylpseudouridine TP; 1-Trifluoromethyl-pseudo-UTP; 1-Vinylpseudouridine TP; 2,2'-anhydro-uridine TP; 2'-bromo-deoxyuridine TP; 2'-F-5-Methyl-2'-deoxy-UTP; 2'-OMe-5-Me-UTP; 2'-OMe-pseudo-UTP; 2'-a-Ethynyluridine TP; 2'-a-Trifluoromethyluridine TP; 2'-b-Ethynyluridine TP; 2'-b-Trifluoromethyluridine TP; 2'-Deoxy-2',2'-difluorouridine TP; 2'-Deoxy-2'-a-mercaptouridine TP; 2'-Deoxy-2'-a-thiomethoxyuridine TP; 2'-Deoxy-2'-b-aminouridine TP; 2'-Deoxy-2'-b-azidouridine TP; 2'-Deoxy-2'-b-bromouridine TP; 2'-Deoxy-2'-b-chlorouridine TP; 2'-Deoxy-2'-b-fluorouridine TP; 2'-Deoxy-2'-b-iodouridine TP; 2'-Deoxy-2'-b-mercaptouridine TP; 2'-Deoxy-2'-b-thiomethoxyuridine TP; 2-methoxy-4-thio-uridine; 2-methoxyuridine; 2'-O-Methyl-5-(1-propynyl)uridine TP; 3-Alkyl-pseudo-UTP; 4'-Azidouridine TP; 4'-Carbocyclic uridine TP; 4'-Ethynyluridine TP; 5-(1-Propynyl)ara-uridine TP; 5-(2-Furanyl)uridine TP; 5-Cyanouridine TP; 5-Dimethylaminouridine TP; 5'-Homo-uridine TP; 5-iodo-2'-fluoro-deoxyuridine TP; 5-Phenylethynyluridine TP; 5-Trideuteromethyl-6-deuterouridine TP; 5-Trifluoromethyl-Uridine TP; 5-Vinylarauridine TP; 6-(2,2,2-Trifluoroethyl)-pseudo-UTP; 6-(4-Morpholino)-pseudo-UTP; 6-(4-Thiomorpholino)-pseudo-UTP; 6-(Substituted-Phenyl)-pseudo-UTP; 6-Amino-pseudo-UTP; 6-Azido-pseudo-UTP; 6-Bromo-pseudo-UTP; 6-Butyl-pseudo-UTP; 6-Chloro-pseudo-UTP; 6-Cyano-pseudo-UTP; 6-Dimethylamino-pseudo-UTP; 6-Ethoxy-pseudo-UTP; 6-Ethylcarboxylate-pseudo-UTP; 6-Ethyl-pseudo-UTP; 6-Fluoro-pseudo-UTP; 6-Formyl-pseudo-UTP; 6-Hydroxyamino-pseudo-UTP; 6-Hydroxy-pseudo-UTP; 6-Iodo-pseudo-UTP; 6-iso-Propyl-pseudo-UTP; 6-Methoxy-pseudo-UTP; 6-Methylamino-pseudo-UTP; 6-Methyl-pseudo-UTP; 6-Phenyl-pseudo-UTP; 6-Phenyl-pseudo-UTP; 6-Propyl-pseudo-UTP; 6-tert-Butyl-pseudo-UTP; 6-Trifluoromethoxy-pseudo-UTP; 6-Trifluoromethyl-pseudo-UTP; Alpha-thio-pseudo-UTP; Pseudouridine 1-(4-methylbenzenesulfonic acid) TP; Pseudouridine 1-(4-methylbenzoic acid) TP; Pseudouridine TP 1-[3-(2-ethoxy)]propionic acid; Pseudouridine TP 1-[3-{2-(2-[2-(2-ethoxy)-ethoxy]-ethoxy)-ethoxyl}]propionic acid; Pseudouridine TP 1-[3-{2-(2-[2-{2 (2-ethoxy)-ethoxy}-ethoxy]-ethoxy)-ethoxyl}]propionic acid; Pseudouridine TP 1-[3-{2-(2-[2-ethoxy]-ethoxy)-ethoxyl}]propionic acid; Pseudouridine TP 1-[3-{2-(2-ethoxy)-ethoxy}] propionic acid; Pseudouridine TP 1-methylphosphonic acid; Pseudouridine TP 1-methylphosphonic acid diethyl ester; Pseudo-UTP-N1-3-propionic acid; Pseudo-UTP-N1-4-butanoic acid; Pseudo-UTP-N1-5-pentanoic acid; Pseudo-UTP-N1-6-hexanoic acid; Pseudo-UTP-N1-7-heptanoic acid; Pseudo-UTP-N1-methyl-p-benzoic acid; Pseudo-UTP-N1-p-benzoic acid; Wybutosine; Hydroxywybutosine; Isowyosine; Peroxywybutosine; undermodified hydroxywybutosine; 4-demethylwyosine; 2,6-(diamino)purine;1-(aza)-2-(thio)-3-(aza)-phenoxazin-1-yl: 1,3-(diaza)-2-(oxo)-phenthiazin-1-yl;1,3-(diaza)-2-(oxo)-phenoxazin-1-yl;1,3,5-(triaza)-2,6-(dioxa)-naphthalene;2 (amino)purine;2,4,5-(trimethyl)phenyl;2'methyl, 2'amino, 2'azido, 2'fluro-cytidine;2'methyl, 2'amino, 2'azido, 2'fluro-adenine;2'methyl, 2'amino, 2'azido, 2'fluro-uridine; 2'-amino-2'-deoxyribose; 2-amino-6-Chloro-purine; 2-aza-inosinyl; 2'-azido-2'-deoxyribose; 2'fluoro-2'-deoxyribose; 2'-fluoro-modified bases; 2'-O-methyl-ribose; 2-oxo-7-aminopyridopyrimidin-3-yl; 2-oxo-pyridopyrimidine-3-yl; 2-pyridinone; 3 nitropyrrole; 3-(methyl)-7-(propynyl)isocarbostyrilyl; 3-(methyl)isocarbostyrilyl; 4-(fluoro)-6-(methyl)benzimidazole; 4-(methyl)benzimidazole; 4-(methyl)indolyl; 4,6-(dimethyl)indolyl; 5 nitroindole; 5 substituted pyrimidines; 5-(methyl)isocarbostyrilyl; 5-nitroindole; 6-(aza)pyrimidine; 6-(azo)thymine; 6-(methyl)-7-(aza)indolyl; 6-chloro-purine; 6-phenyl-pyrrolo-pyrimidin-2-on-3-yl; 7-(aminoalkylhydroxy)-1-(aza)-2-(thio)-3-(aza)-phenthiazin-1-yl; 7-(aminoalkylhydroxy)-1-(aza)-2-(thio)-3-(aza)-phenoxazin-1-yl; 7-(aminoalkylhydroxy)-1,3-(diaza)-2-(oxo)-phenoxazin-1-yl; 7-(aminoalkylhydroxy)-1,3-(diaza)-2-(oxo)-phenthiazin-1-yl; 7-(aminoalkylhydroxy)-1,3-(diaza)-2-(oxo)-phenoxazin-1-yl; 7-(aza)indolyl; 7-(guanidiniumalkylhydroxy)-1-(aza)-2-(thio)-3-(aza)-phenoxazinl-yl; 7-(guanidiniumalkylhydroxy)-1-(aza)-2-(thio)-3-(aza)-phenthiazin-1-yl; 7-(guanidiniumalkylhydroxy)-1-(aza)-2-(thio)-3-(aza)-phenoxazin-1-yl; 7-(guanidiniumalkylhydroxy)-1,3-(diaza)-2-(oxo)-phenoxazin-1-yl; 7-(guanidiniumalkyl-hydroxy)-1,3-(diaza)-2-(oxo)-phenthiazin-1-yl; 7-(guanidiniumalkylhydroxy)-1,3-(diaza)-2-(oxo)-phenoxazin-1-yl; 7-(propynyl)isocarbostyrilyl; 7-(propynyl)isocarbostyrilyl, propynyl-7-(aza)indolyl; 7-deaza-inosinyl; 7-substituted 1-(aza)-2-(thio)-3-(aza)-phenoxazin-1-yl; 7-substituted 1,3-(diaza)-2-(oxo)-phenoxazin-1-yl; 9-(methyl)-imidizopyridinyl; Aminoindolyl; Anthracenyl; bis-ortho-(aminoalkylhydroxy)-6-phenyl-pyrrolo-pyrimidin-2-on-3-yl; bis-ortho-substituted-6-phenyl-pyrrolo-pyrimidin-2-on-3-yl; Difluorotolyl; Hypoxanthine; Imidizopyridinyl; Inosinyl; Isocarbostyrilyl; Isoguanisine; N2-substituted purines; N6-methyl-2-amino-purine; N6-substituted purines; N-alkylated derivative; Napthalenyl; Nitrobenzimidazolyl; Nitroimidazolyl; Nitroindazolyl; Nitropyrazolyl; Nubularine; O6-substituted purines; O-alkylated derivative; ortho-(aminoalkylhydroxy)-6-phenyl-pyrrolo-pyrimidin-2-on-3-yl; ortho-substituted-6-phenyl-pyrrolo-pyrimidin-2-on-3-yl; Oxoformycin TP; para-(aminoalkylhydroxy)-6-phenyl-pyrrolo-pyrimidin-2-on-3-yl; para-substituted-6-phenyl-pyrrolo-pyrimidin-2-on-3-yl; Pentacenyl; Phenanthracenyl; Phenyl; propynyl-7-(aza)indolyl; Pyrenyl; pyridopyrimidin-3-yl; pyridopyrimidin-3-yl, 2-oxo-7-amino-pyridopyrimidin-3-yl; pyrrolo-pyrimidin-2-on-3-yl; Pyrrolopyrimidinyl; Pyrrolopyrizinyl; Stilbenzyl; substituted 1,2,4-triazoles; Tetracenyl; Tubercidine; Xanthine; Xanthosine-5'-TP; 2-thio-zebularine; 5-aza-2-thio-zebularine; 7-deaza-2-amino-purine; pyridin-4-one ribonucleoside; 2-Amino-riboside-TP; Formycin A TP; Formycin B TP; Pyrrolosine TP; 2'-OH-ara-adenosine TP; 2'-OH-ara-cytidine TP; 2'-OH-ara-uridine TP; 2'-OH-ara-guanosine TP; 5-(2-carbomethoxyvinyl)uridine TP; and N6-(19-Amino-pentaoxanonadecyl)adenosine TP.

In some embodiments, the polynucleotide (e.g., RNA polynucleotide, such as mRNA polynucleotide) includes a combination of at least two (e.g., 2, 3, 4 or more) of the aforementioned modified nucleobases.

In some embodiments, the mRNA comprises at least one chemically modified nucleoside. In some embodiments, the at least one chemically modified nucleoside is selected from the group consisting of pseudouridine (ψ), 2-thiouridine (s2U), 4'-thiouridine, 5-methylcytosine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methylpseudouridine, 4-thio-pseudouridine, 5-aza-uridine, dihydropseudouridine, 5-methyluridine, 5-methoxyuridine, 2'-O-methyl uridine, 1-methyl-pseudouridine (m1ψ), 1-ethyl-pseudouridine (e1ψ), 5-methoxy-uridine (mo5U), 5-methyl-cytidine (m5C), α-thio-guanosine, α-thio-adenosine, 5-cyano uridine, 4'-thio uridine 7-deaza-adenine, 1-methyl-adenosine (m1A), 2-methyl-adenine (m2A), N6-methyl-adenosine (m6A), and 2,6-Diaminopurine, (I), 1-methyl-inosine (m1I), wyosine (imG), methylwyosine (mimG), 7-deaza-guanosine, 7-cyano-7-deaza-guanosine (preQ0), 7-aminomethyl-7-deaza-guanosine (preQ1), 7-methyl-guanosine (m7G), 1-methyl-guanosine (m1G), 8-oxo-guanosine, 7-methyl-8-oxo-guanosine, 2,8-dimethyladenosine, 2-geranylthiouridine, 2-lysidine, 2-selenouridine, 3-(3-amino-3-carboxypropyl)-5,6-dihydrouridine, 3-(3-amino-3-carboxypropyl)pseudouridine, 3-methylpseudouridine, 5-(carboxyhydroxymethyl)-2'-O-methyluridine methyl ester, 5-aminomethyl-2-geranylthiouridine, 5-aminomethyl-2-selenouridine, 5-aminomethyluridine, 5-carbamoylhydroxymethyluridine, 5-carbamoylmethyl-2-thiouridine, 5-carboxymethyl-2-thiouridine, 5-carboxymethylaminomethyl-2-geranylthiouridine, 5-carboxymethylaminomethyl-2-selenouridine, 5-cyanomethyluridine, 5-hydroxycytidine, 5-methylaminomethyl-2-geranylthiouridine, 7-aminocarboxypropyl-demethylwyosine, 7-aminocarboxypropylwyosine, 7-aminocarboxypropylwyosine methyl ester, 8-methyladenosine, N4,N4-dimethylcytidine, N6-formyladenosine, N6-hydroxymethyladenosine, agmatidine, cyclic N6-threonylcarbamoyladenosine, glutamylqueuosine, methylated undermodified hydroxywybutosine, N4,N4,2'-O-trimethylcytidine, geranylated 5-methylaminomethyl-2-thiouridine, geranylated 5-carboxymethylaminomethyl-2-thiouridine, Qbase, preQ0base, preQ1base, and two or more combinations thereof. In some embodiments, the at least one chemically modified nucleoside is selected from the group consisting of pseudouridine, 1-methyl-pseudouridine, 1-ethyl-pseudouridine, 5-methylcytosine, 5-methoxyuridine, and a combination thereof. In some embodiments, the polynucleotide (e.g., RNA polynucleotide, such as mRNA polynucleotide) includes a combination of at least two (e.g., 2, 3, 4 or more) of the aforementioned modified nucleobases.

(i) Base Modifications

In certain embodiments, the chemical modification is at nucleobases in the polynucleotides (e.g., RNA polynucleotide, such as mRNA polynucleotide). In some embodiments, modified nucleobases in the polynucleotide (e.g., RNA polynucleotide, such as mRNA polynucleotide) are selected from the group consisting of 1-methyl-pseudouridine (m1ψ), 1-ethyl-pseudouridine (e1ψ), 5-methoxy-uridine (mo5U), 5-methyl-cytidine (m5C), pseudouridine (ψ), α-thio-guanosine and α-thio-adenosine. In some embodiments, the polynucleotide includes a combination of at least two (e.g., 2, 3, 4 or more) of the aforementioned modified nucleobases.

In some embodiments, the polynucleotide (e.g., RNA polynucleotide, such as mRNA polynucleotide) comprises pseudouridine (ψ) and 5-methyl-cytidine (m5C). In some embodiments, the polynucleotide (e.g., RNA polynucleotide, such as mRNA polynucleotide) comprises 1-methyl-pseudouridine (m1ψ). In some embodiments, the polynucleotide (e.g., RNA polynucleotide, such as mRNA polynucleotide) comprises 1-ethyl-pseudouridine (e1ψ). In some embodiments, the polynucleotide (e.g., RNA polynucleotide, such as mRNA polynucleotide) comprises 1-methyl-pseudouridine (m1ψ) and 5-methyl-cytidine (m5C). In some embodiments, the polynucleotide (e.g., RNA polynucleotide, such as mRNA polynucleotide) comprises 1-ethyl-pseudouridine (e1ψ) and 5-methyl-cytidine (m5C). In some embodiments, the polynucleotide (e.g., RNA polynucleotide, such as mRNA polynucleotide) comprises 2-thiouridine (s2U). In some embodiments, the polynucleotide (e.g., RNA polynucleotide, such as mRNA polynucleotide) comprises 2-thiouridine and 5-methyl-cytidine (m5C). In some embodiments, the polynucleotide (e.g., RNA polynucleotide, such as mRNA polynucleotide) comprises methoxy-uridine (mo5U). In some embodiments, the polynucleotide (e.g., RNA polynucleotide, such as mRNA polynucleotide) comprises 5-methoxy-uridine (mo5U) and 5-methyl-cytidine (m5C). In some embodiments, the polynucleotide (e.g., RNA polynucleotide, such as mRNA polynucleotide) comprises 2'-O-methyl uridine. In some embodiments, the polynucleotide (e.g., RNA polynucleotide, such as mRNA polynucleotide) comprises 2'-O-methyl uridine and 5-methyl-cytidine (m5C). In some embodiments, the polynucleotide (e.g., RNA polynucleotide, such as mRNA polynucleotide) comprises N6-methyl-adenosine (m6A). In some embodiments, the polynucleotide (e.g., RNA polynucleotide, such as mRNA polynucleotide) comprises N6-methyl-adenosine (m6A) and 5-methyl-cytidine (m5C).

In some embodiments, the polynucleotide (e.g., RNA polynucleotide, such as mRNA polynucleotide) is uniformly modified (e.g., fully modified, modified throughout the entire sequence) for a particular modification. For example, a polynucleotide can be uniformly modified with 5-methyl-cytidine (m5C), meaning that all cytosine residues in the mRNA sequence are replaced with 5-methyl-cytidine (m5C). Similarly, a polynucleotide can be uniformly modified for any type of nucleoside residue present in the sequence by replacement with a modified residue such as any of those set forth above.

In some embodiments, the chemically modified nucleosides in the open reading frame are selected from the group consisting of uridine, adenine, cytosine, guanine, and any combination thereof.

In some embodiments, the modified nucleobase is a modified cytosine. Examples of nucleobases and nucleosides having a modified cytosine include N4-acetyl-cytidine (ac4C), 5-methyl-cytidine (m5C), 5-halo-cytidine (e.g., 5-iodo-cytidine), 5-hydroxymethyl-cytidine (hm5C), 1-methyl-pseudoisocytidine, 2-thio-cytidine (s2C), 2-thio-5-methyl-cytidine.

In some embodiments, a modified nucleobase is a modified uridine. Example nucleobases and nucleosides having a modified uridine include 5-cyano uridine or 4'-thio uridine.

In some embodiments, a modified nucleobase is a modified adenine. Example nucleobases and nucleosides having a modified adenine include 7-deaza-adenine, 1-methyl-adenosine (m1A), 2-methyl-adenine (m2A), N6-methyl-adenine (m6A), and 2,6-Diaminopurine.

In some embodiments, a modified nucleobase is a modified guanine. Example nucleobases and nucleosides having a modified guanine include inosine (I), 1-methyl-inosine (m1I), wyosine (imG), methylwyosine (mimG), 7-deaza-guanosine, 7-cyano-7-deaza-guanosine (preQ0), 7-aminomethyl-7-deaza-guanosine (preQ1), 7-methyl-guanosine (m7G), 1-methyl-guanosine (m1G), 8-oxo-guanosine, 7-methyl-8-oxo-guanosine.

In some embodiments, the nucleobase modified nucleotides in the polynucleotide (e.g., RNA polynucleotide, such as mRNA polynucleotide) are 5-methoxyuridine.

In some embodiments, the polynucleotide (e.g., RNA polynucleotide, such as mRNA polynucleotide) includes a combination of at least two (e.g., 2, 3, 4 or more) of modified nucleobases.

In some embodiments, at least 95% of a type of nucleobases (e.g., uracil) in a polynucleotide of the present disclosure (e.g., an mRNA polynucleotide encoding CFTR) are modified nucleobases. In some embodiments, at least 95% of uracil in a polynucleotide of the present disclosure (e.g., an mRNA polynucleotide encoding CFTR) is 5-methoxyuracil.

In some embodiments, the polynucleotide (e.g., RNA polynucleotide, such as mRNA polynucleotide) comprises 5-methoxyuridine (5mo5U) and 5-methyl-cytidine (m5C).

In some embodiments, the polynucleotide (e.g., RNA polynucleotide, such as mRNA polynucleotide) is uniformly modified (e.g., fully modified, modified throughout the entire sequence) for a particular modification. For example, a polynucleotide can be uniformly modified with 5-methoxyuridine, meaning that substantially all uridine residues in the mRNA sequence are replaced with 5-methoxyuridine. Similarly, a polynucleotide can be uniformly modified for any type of nucleoside residue present in the sequence by replacement with a modified residue such as any of those set forth above.

In some embodiments, the modified nucleobase is a modified cytosine.

In some embodiments, a modified nucleobase is a modified uracil. Example nucleobases and nucleosides having a modified uracil include 5-methoxyuracil.

In some embodiments, a modified nucleobase is a modified adenine.

In some embodiments, a modified nucleobase is a modified guanine.

In some embodiments, the nucleobases, sugar, backbone, or any combination thereof in the open reading frame encoding a CFTR polypeptideare chemically modified by at least 10%, at least 20%, at least 30%, at least 40%, at least 50%, at least 60%, at least 70%, at least 80%, at least 90%, at least 95%, at least 99%, or 100%.

In some embodiments, the uridine nucleosides in the open reading frame encoding a CFTR polypeptideare chemically modified by at least 10%, at least 20%, at least 30%, at least 40%, at least 50%, at least 60%, at least 70%, at least 80%, at least 90%, at least 95%, at least 99%, or 100%.

In some embodiments, the adenosine nucleosides in the open reading frame encoding a CFTR polypeptideare chemically modified by at least 10%, at least 20%, at least 30%, at least 40%, at least 50%, at least 60%, at least 70%, at least 80%, at least 90%, at least 95%, at least 99%, or 100%.

In some embodiments, the cytidine nucleosides in the open reading frame encoding a CFTR polypeptideare chemically modified by at least at least 10%, at least 20%, at least 30%, at least 40%, at least 50%, at least 60%, at least 70%, at least 80%, at least 90%, at least 95%, at least 99%, or 100%.

In some embodiments, the guanosine nucleosides in the open reading frame encoding a CFTR polypeptide are chemically modified by at least at least 10%, at least 20%, at least 30%, at least 40%, at least 50%, at least 60%, at least 70%, at least 80%, at least 90%, at least 95%, at least 99%, or 100%.

In some embodiments, the polynucleotides can include any useful linker between the nucleosides. Such linkers, including backbone modifications, that are useful in the composition of the present disclosure include, but are not limited to the following: 3'-alkylene phosphonates, 3'-amino phosphoramidate, alkene containing backbones, aminoalkylphosphoramidates, aminoalkylphosphotriesters, boranophosphates, —CH$_2$—O—N(CH$_3$)—CH$_2$—, —CH$_2$—N(CH$_3$)—N(CH$_3$)—CH$_2$—, —CH$_2$—NH—CH$_2$—, chiral phosphonates, chiral phosphorothioates, formacetyl and thioformacetyl backbones, methylene (methylimino), methylene formacetyl and thioformacetyl backbones, methyleneimino and methylenehydrazino backbones, morpholino linkages, —N(CH$_3$)—CH$_2$—CH$_2$—, oligonucleosides with heteroatom internucleoside linkage, phosphinates, phosphoramidates, phosphorodithioates, phosphorothioate internucleoside linkages, phosphorothioates, phosphotriesters, PNA, siloxane backbones, sulfamate backbones, sulfide sulfoxide and sulfone backbones, sulfonate and sulfonamide backbones, thionoalkylphosphonates, thionoalkylphosphotriesters, and thionophosphoramidates.

(ii) Sugar Modifications

The modified nucleosides and nucleotides (e.g., building block molecules), which can be incorporated into a polynucleotide (e.g., RNA or mRNA, as described herein), can be modified on the sugar of the ribonucleic acid. For example, the 2' hydroxyl group (OH) can be modified or replaced with a number of different substituents. Exemplary substitutions at the 2'-position include, but are not limited to, H, halo, optionally substituted C$_{1-6}$ alkyl; optionally substituted C$_{1-6}$ alkoxy; optionally substituted C$_{6-10}$ aryloxy; optionally substituted C$_{3-8}$ cycloalkyl; optionally substituted C$_{3-8}$ cycloalkoxy; optionally substituted C$_{6-10}$ aryloxy; optionally substituted C$_{6-10}$ aryl-C$_{1-6}$ alkoxy, optionally substituted C$_{1-12}$ (heterocyclyl)oxy; a sugar (e.g., ribose, pentose, or any described herein); a polyethyleneglycol (PEG), —O(CH$_2$CH$_2$O)$_n$CH$_2$CH$_2$OR, where R is H or optionally substituted alkyl, and n is an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20); "locked" nucleic acids (LNA) in which the 2'-hydroxyl is connected by a C$_{1-6}$ alkylene or C$_{1-6}$ heteroalkylene bridge to the 4'-carbon of the same ribose sugar, where exemplary bridges included methylene, propylene, ether, or amino bridges; aminoalkyl, as defined herein; aminoalkoxy, as defined herein; amino as defined herein; and amino acid, as defined herein Generally, RNA includes the sugar group ribose, which is a 5-membered ring having an oxygen. Exemplary, non-limiting modified nucleotides include replacement of the oxygen in ribose (e.g., with S, Se, or alkylene, such as methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for anhydrohexitol, altritol, mannitol, cyclohexanyl, cyclohexenyl, and morpholino that also has a phosphoramidate backbone); multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replace with α-L-threofuranosyl-(3'→2)), and peptide nucleic acid (PNA, where 2-amino-ethyl-glycine linkages replace the ribose and phosphodiester backbone). The sugar group can also contain one or more carbons that possess the opposite stereochemical configuration than that of the corresponding carbon in ribose. Thus, a polynucleotide molecule can include nucleotides containing, e.g., arabinose, as the sugar. Such sugar modifications are taught International Patent Publication Nos. WO2013052523 and WO2014093924, the contents of each of which are incorporated herein by reference in their entireties.

(iii) Combinations of Modifications

The polynucleotides of the present disclosure (e.g., a polynucleotide comprising a nucleotide sequence encoding a CFTR polypeptide or a functional fragment or variant thereof) can include a combination of modifications to the sugar, the nucleobase, and/or the internucleoside linkage. These combinations can include any one or more modifications described herein.

Combinations of modified nucleotides can be used to form the polynucleotides of the present disclosure. Unless otherwise noted, the modified nucleotides can be completely substituted for the natural nucleotides of the polynucleotides of the present disclosure. As a non-limiting example, the natural nucleotide uridine can be substituted with a modified nucleoside described herein. In another non-limiting example, the natural nucleotide uridine can be partially substituted or replaced (e.g., about 0.1%, 1%, 5%, 10%, 15%, 20%, 25%, 30%, 35%, 40%, 45%, 50%, 55%, 60%, 65%, 70%, 75%, 80%, 85%, 90%, 95% or 99.9%) with at least one of the modified nucleoside disclosed herein. Any combination of base/sugar or linker can be incorporated into the polynucleotides of the present disclosure and such modifications are taught in International Patent Publications WO2013052523 and WO2014093924, and U.S. Publ. Nos. US 20130115272 and US20150307542, the contents of each of which are incorporated herein by reference in its entirety.

11. Untranslated Regions (UTRs)

Untranslated regions (UTRs) are nucleic acid sections of a polynucleotide before a start codon (5'UTR) and after a stop codon (3'UTR) that are not translated. In some embodiments, a polynucleotide (e.g., a ribonucleic acid (RNA), e.g., a messenger RNA (mRNA)) of the present disclosure comprising an open reading frame (ORF) encoding a CFTR polypeptide further comprises UTR (e.g., a 5'UTR or functional fragment thereof, a 3'UTR or functional fragment thereof, or a combination thereof).

A UTR can be homologous or heterologous to the coding region in a polynucleotide. In some embodiments, the UTR is homologous to the ORF encoding the CFTR polypeptide. In some embodiments, the UTR is heterologous to the ORF encoding the CFTR polypeptide. In some embodiments, the polynucleotide comprises two or more 5'UTRs or functional fragments thereof, each of which have the same or different nucleotide sequences. In some embodiments, the polynucleotide comprises two or more 3'UTRs or functional fragments thereof, each of which have the same or different nucleotide sequences.

In some embodiments, the 5'UTR or functional fragment thereof, 3'UTR or functional fragment thereof, or any combination thereof is sequence optimized.

In some embodiments, the 5'UTR or functional fragment thereof, 3'UTR or functional fragment thereof, or any combination thereof comprises at least one chemically modified nucleobase, e.g., 5-methoxyuracil.

UTRs can have features that provide a regulatory role, e.g., increased or decreased stability, localization and/or translation efficiency. A polynucleotide comprising a UTR can be administered to a cell, tissue, or organism, and one or more regulatory features can be measured using routine methods. In some embodiments, a functional fragment of a 5'UTR or 3'UTR comprises one or more regulatory features of a full length 5' or 3'UTR, respectively.

Natural 5'UTRs bear features that play roles in translation initiation. They harbor signatures like Kozak sequences that are commonly known to be involved in the process by which the ribosome initiates translation of many genes. Kozak sequences have the consensus CCR(A/G)CCAUGG, where R is a purine (adenine or guanine) three bases upstream of the start codon (AUG), which is followed by another 'G'. 5'UTRs also have been known to form secondary structures that are involved in elongation factor binding.

By engineering the features typically found in abundantly expressed genes of specific target organs, one can enhance the stability and protein production of a polynucleotide. For example, introduction of 5'UTR of liver-expressed mRNA, such as albumin, serum amyloid A, Apolipoprotein A/B/E, transferrin, alpha fetoprotein, erythropoietin, or Factor VIII, can enhance expression of polynucleotides in hepatic cell lines or liver. Likewise, use of 5'UTR from other tissue-specific mRNA to improve expression in that tissue is possible for muscle (e.g., MyoD, Myosin, Myoglobin, Myogenin, Herculin), for endothelial cells (e.g., Tie-1, CD36), for myeloid cells (e.g., C/EBP, AML1, G-CSF, GM-CSF, CD11b, MSR, Fr-1, i-NOS), for leukocytes (e.g., CD45, CD18), for adipose tissue (e.g., CD36, GLUT4, ACRP30, adiponectin) and for lung epithelial cells (e.g., SP-A/B/C/D).

In some embodiments, UTRs are selected from a family of transcripts whose proteins share a common function, structure, feature or property. For example, an encoded polypeptide can belong to a family of proteins (i.e., that share at least one function, structure, feature, localization, origin, or expression pattern), which are expressed in a particular cell, tissue or at some time during development. The UTRs from any of the genes or mRNA can be swapped for any other UTR of the same or different family of proteins to create a new polynucleotide.

In some embodiments, the 5'UTR and the 3'UTR can be heterologous. In some embodiments, the 5'UTR can be derived from a different species than the 3'UTR. In some embodiments, the 3'UTR can be derived from a different species than the 5'UTR.

Co-owned International Patent Application No. PCT/US2014/021522 (Publ. No. WO/2014/164253, incorporated herein by reference in its entirety) provides a listing of exemplary UTRs that can be utilized in the polynucleotide of the present disclosure as flanking regions to an ORF.

Exemplary UTRs of the application include, but are not limited to, one or more 5'UTR and/or 3'UTR derived from the nucleic acid sequence of: a globin, such as an α- or β-globin (e.g., a Xenopus, mouse, rabbit, or human globin); a strong Kozak translational initiation signal; a CYBA (e.g., human cytochrome b-245 α polypeptide); an albumin (e.g., human albumin7); a HSD17B4 (hydroxysteroid (17-β) dehydrogenase); a virus (e.g., a tobacco etch virus (TEV), a Venezuelan equine encephalitis virus (VEEV), a Dengue virus, a cytomegalovirus (CMV) (e.g., CMV immediate early 1 (IE1)), a hepatitis virus (e.g., hepatitis B virus), a sindbis virus, or a PAV barley yellow dwarf virus); a heat shock protein (e.g., hsp70); a translation initiation factor (e.g., eIF4G); a glucose transporter (e.g., hGLUT1 (human glucose transporter 1)); an actin (e.g., human α or β actin); a GAPDH; a tubulin; a histone; a citric acid cycle enzyme; a topoisomerase (e.g., a 5'UTR of a TOP gene lacking the 5' TOP motif (the oligopyrimidine tract)); a ribosomal protein Large 32 (L32); a ribosomal protein (e.g., human or mouse ribosomal protein, such as, for example, rps9); an ATP synthase (e.g., ATP5A1 or the β subunit of mitochondrial $H^+$-ATP synthase); a growth hormone e (e.g., bovine (bGH) or human (hGH)); an elongation factor (e.g., elongation factor 1 α1 (EEF1A1)); a manganese superoxide dismutase (MnSOD); a myocyte enhancer factor 2A (MEF2A); a β-F1-ATPase, a creatine kinase, a myoglobin, a granulocyte-colony stimulating factor (G-CSF); a collagen (e.g., collagen type I, alpha 2 (Col1A2), collagen type I, alpha 1 (CollA1), collagen type VI, alpha 2 (Col6A2), collagen type VI, alpha 1 (Col6A1)); a ribophorin (e.g., ribophorin I (RPNI)); a low density lipoprotein receptor-related protein (e.g., LRP1); a cardiotrophin-like cytokine factor (e.g., Nnt1); calreticulin (Calr); a procollagen-lysine, 2-oxoglutarate 5-dioxygenase 1 (Plod1); and a nucleobindin (e.g., Nucb1).

In some embodiments, the 5'UTR is selected from the group consisting of a β-globin 5'UTR; a 5'UTR containing a strong Kozak translational initiation signal; a cytochrome b-245 α polypeptide (CYBA) 5'UTR; a hydroxysteroid (17-β) dehydrogenase (HSD17B4) 5'UTR; a Tobacco etch virus (TEV) 5'UTR; a Venezuelen equine encephalitis virus (TEEV) 5'UTR; a 5' proximal open reading frame of rubella virus (RV) RNA encoding nonstructural proteins; a Dengue virus (DEN) 5'UTR; a heat shock protein 70 (Hsp70) 5'UTR; a eIF4G 5'UTR; a GLUT1 5'UTR; functional fragments thereof and any combination thereof.

In some embodiments, the 3'UTR is selected from the group consisting of a β-globin 3'UTR; a CYBA 3'UTR; an albumin 3'UTR; a growth hormone (GH) 3'UTR; a VEEV 3'UTR; a hepatitis B virus (HBV) 3'UTR; α-globin 3'UTR; a DEN 3'UTR; a PAV barley yellow dwarf virus (BYDV-PAV) 3'UTR; an elongation factor 1 α1 (EEF1A1) 3'UTR; a manganese superoxide dismutase (MnSOD) 3'UTR; a (3 subunit of mitochondrial H(+)-ATP synthase (β-mRNA) 3'UTR; a GLUT1 3'UTR; a MEF2A 3'UTR; a β-F1-ATPase 3'UTR; functional fragments thereof and combinations thereof.

Wild-type UTRs derived from any gene or mRNA can be incorporated into the polynucleotides of the present disclosure. In some embodiments, a UTR can be altered relative to a wild type or native UTR to produce a variant UTR, e.g., by changing the orientation or location of the UTR relative to the ORF; or by inclusion of additional nucleotides, deletion of nucleotides, swapping or transposition of nucleotides. In some embodiments, variants of 5' or 3' UTRs can be utilized, for example, mutants of wild type UTRs, or variants wherein one or more nucleotides are added to or removed from a terminus of the UTR.

Additionally, one or more synthetic UTRs can be used in combination with one or more non-synthetic UTRs. See, e.g., Mandal and Rossi, Nat. Protoc. 2013 8(3):568-82, and sequences available at www.addgene.org/Derrick_Rossi/, the contents of each are incorporated herein by reference in their entirety. UTRs or portions thereof can be placed in the same orientation as in the transcript from which they were selected or can be altered in orientation or location. Hence, a 5' and/or 3' UTR can be inverted, shortened, lengthened, or combined with one or more other 5' UTRs or 3' UTRs.

In some embodiments, the polynucleotide comprises multiple UTRs, e.g., a double, a triple or a quadruple 5'UTR or 3'UTR. For example, a double UTR comprises two copies of the same UTR either in series or substantially in series. For example, a double beta-globin 3'UTR can be used (see US2010/0129877, the contents of which are incorporated herein by reference in its entirety).

In certain embodiments, the polynucleotides of the present disclosure comprise a 5'UTR and/or a 3'UTR selected from any of the UTRs disclosed herein. In some embodiments, the 5'UTR comprises:

TABLE 3

| Name | SEQ ID NO: |
|---|---|
| 5'UTR-001 (Upstream UTR) | 55 |
| 5'UTR-002 (Upstream UTR) | 56 |
| 5'UTR-003 (Upstream UTR) | 57 |
| 5'UTR-004 (Upstream UTR) | 58 |
| 5'UTR-005 (Upstream UTR) | 59 |
| 5'UTR-006 (Upstream UTR) | 60 |
| 5'UTR-007 (Upstream UTR) | 61 |
| 5'UTR-008 (Upstream UTR) | 62 |
| 5'UTR-009 (Upstream UTR) | 63 |
| 5'UTR-010 (Upstream UTR) | 64 |
| 5'UTR-011 (Upstream UTR) | 65 |
| 5'UTR-012 (Upstream UTR) | 66 |
| 5'UTR-013 (Upstream UTR) | 67 |
| 5'UTR-014 (Upstream UTR) | 68 |
| 5'UTR-015 (Upstream UTR) | 69 |
| 5'UTR-016 (Upstream UTR) | 70 |
| 5'UTR-017 (Upstream UTR) | 71 |
| 5'UTR-018 (Upstream UTR) | 72 |
| 142-3p 5'UTR-001 (Upstream UTR including miR142-3p binding site) | 73 |
| 142-3p 5'UTR-002 (Upstream UTR including miR142-3p binding site) | 74 |
| 142-3p 5'UTR-003 (Upstream UTR including miR142-3p binding site) | 75 |
| 142-3p 5'UTR-004 (Upstream UTR including miR142-3p binding site) | 75 |
| 142-3p 5'UTR-005 (Upstream UTR including miR142-3p binding site) | 77 |
| 142-3p 5'UTR-006 (Upstream UTR including miR142-3p binding site) | 78 |
| 142-3p 5'UTR-007 (Upstream UTR including miR142-3p binding site) | 79 |
| 3'UTR comprises: 3'UTR-001 (Creatine Kinase UTR) | 80 |
| 3'UTR-002 (Myoglobin UTR) | 81 |
| 3'UTR-003 (α-actin UTR) | 82 |
| 3'UTR-004 (Albumin UTR) | 83 |
| 3'UTR-005 (α-globin UTR) | 84 |
| 3'UTR-006 (G-CSF UTR) | 85 |
| 3'UTR-007 (Col1a2; collagen, type I, alpha 2 UTR) | 86 |
| 3'UTR-008 (Col6a2; collagen, type VI, alpha 2 UTR) | 87 |
| 3'UTR-009 (RPN1; ribophorin I UTR) | 88 |
| 3'UTR-010 (LRP1; low density lipoprotein receptor-related protein 1 UTR) | 89 |
| 3'UTR-011 (Nnt1; cardiotrophin-like cytokine factor 1 UTR) | 90 |

TABLE 3-continued

| Name | SEQ ID NO: |
|---|---|
| 3'UTR-012 (Col6a1; collagen, type VI, alpha 1 UTR) | 91 |
| 3'UTR-013 (Calr; calreticulin UTR) | 92 |
| 3'UTR-014 (Col1a1; collagen, type I, alpha 1 UTR) | 93 |
| 3'UTR-015 (Plod1; procollagen-lysine, 2-oxoglutarate 5-dioxygenase 1 UTR) | 94 |
| 3'UTR-016 (Nucb1; nucleobindin 1 UTR) | 95 |
| 3'UTR-017 (α-globin) | 96 |
| 3'UTR-018 | 97 |
| 3'UTR with miR 142-3p binding site | 156 |
| 3'UTR with miR 126-3p binding site | 157 |
| 3'UTR with miR 142-3p and miR 126-3p binding sites | 158 |
| 3'UTR with 3 miR 142-3p binding sites | 159 |
| 3'UTR with miR 142-5p binding site | 160 |
| 3'UTR with 3 miR 142-5p binding sites | 161 |
| 3'UTR with 2 miR 142-5p binding sites and 1 miR 142-3p binding site | 162 |
| 3'UTR with miR 142-3p binding site, P1 insertion | 163 |
| 3'UTR with miR 142-3p binding site, P2 insertion | 164 |
| 3'UTR with miR 142-3p binding site, P3 insertion | 165 |
| 3'UTR with miR 155-5p binding site | 166 |
| 3'UTR with 3 miR 155-5p binding sites | 167 |
| 3'UTR with 2 miR 155-5p binding sites and 1 miR 142-3p binding site | 168 |

In certain embodiments, the 5'UTR and/or 3'UTR sequence of the present disclosure comprises a nucleotide sequence at least about 60%, at least about 70%, at least about 80%, at least about 90%, at least about 95%, at least about 96%, at least about 97%, at least about 98%, at least about 99%, or about 100% identical to a sequence selected from the group consisting of 5'UTR sequences comprising any of SEQ ID NOs: 55-79 and/or 3'UTR sequences comprises any of SEQ ID NOs: 80-97, and any combination thereof.

The polynucleotides of the present disclosure can comprise combinations of features. For example, the ORF can be flanked by a 5'UTR that comprises a strong Kozak translational initiation signal and/or a 3'UTR comprising an oligo (dT) sequence for templated addition of a poly-A tail. A 5'UTR can comprise a first polynucleotide fragment and a second polynucleotide fragment from the same and/or different UTRs (see, e.g., US2010/0293625, herein incorporated by reference in its entirety).

Other non-UTR sequences can be used as regions or subregions within the polynucleotides of the present disclosure. For example, introns or portions of intron sequences can be incorporated into the polynucleotides of the present disclosure. Incorporation of intronic sequences can increase protein production as well as polynucleotide expression levels. In some embodiments, the polynucleotide of the present disclosure comprises an internal ribosome entry site (IRES) instead of or in addition to a UTR (see, e.g., Yakubov et al., Biochem. Biophys. Res. Commun. 2010 394(1):189-193, the contents of which are incorporated herein by reference in their entirety). In some embodiments, the polynucleotide comprises an IRES instead of a 5'UTR sequence. In some embodiments, the polynucleotide comprises an ORF and a viral capsid sequence. In some embodiments, the polynucleotide comprises a synthetic 5'UTR in combination with a non-synthetic 3'UTR.

In some embodiments, the UTR can also include at least one translation enhancer polynucleotide, translation enhancer element, or translational enhancer elements (collectively, "TEE," which refers to nucleic acid sequences that increase the amount of polypeptide or protein produced from a polynucleotide. As a non-limiting example, the TEE can include those described in US2009/0226470, incorporated herein by reference in its entirety, and others known in the art. As a non-limiting example, the TEE can be located between the transcription promoter and the start codon. In some embodiments, the 5'UTR comprises a TEE.

In one aspect, a TEE is a conserved element in a UTR that can promote translational activity of a nucleic acid such as, but not limited to, cap-dependent or cap-independent translation.

In one non-limiting example, the TEE comprises the TEE sequence in the 5'-leader of the Gtx homeodomain protein. See Chappell et al., PNAS 2004 101:9590-9594, incorporated herein by reference in its entirety.

"Translational enhancer polynucleotide" or "translation enhancer polynucleotide sequence" refer to a polynucleotide that includes one or more of the TEE provided herein and/or known in the art (see. e.g., U.S. Pat. Nos. 6,310,197, 6,849,405, 7,456,273, 7,183,395, US2009/0226470, US2007/0048776, US2011/0124100, US2009/0093049, US2013/0177581, WO2009/075886, WO2007/025008, WO2012/009644, WO2001/055371, WO1999/024595, EP2610341A1, and EP2610340A1; the contents of each of which are incorporated herein by reference in their entirety), or their variants, homologs, or functional derivatives. In some embodiments, the polynucleotide of the present disclosure comprises one or multiple copies of a TEE. The TEE in a translational enhancer polynucleotide can be organized in one or more sequence segments. A sequence segment can harbor one or more of the TEEs provided herein, with each TEE being present in one or more copies. When multiple sequence segments are present in a translational enhancer polynucleotide, they can be homogenous or heterogeneous. Thus, the multiple sequence segments in a translational enhancer polynucleotide can harbor identical or different types of the TEE provided herein, identical or different number of copies of each of the TEE, and/or identical or different organization of the TEE within each sequence segment. In one embodiment, the polynucleotide of the present disclosure comprises a translational enhancer polynucleotide sequence.

In some embodiments, a 5'UTR and/or 3'UTR comprising at least one TEE described herein can be incorporated in a monocistronic sequence such as, but not limited to, a vector system or a nucleic acid vector.

In some embodiments, a 5'UTR and/or 3'UTR of a polynucleotide of the present disclosure comprises a TEE or portion thereof described herein. In some embodiments, the TEEs in the 3'UTR can be the same and/or different from the TEE located in the 5'UTR.

In some embodiments, a 5'UTR and/or 3'UTR of a polynucleotide of the present disclosure can include at least 1, at least 2, at least 3, at least 4, at least 5, at least 6, at least 7, at least 8, at least 9, at least 10, at least 11, at least 12, at least 13, at least 14, at least 15, at least 16, at least 17, at least 18 at least 19, at least 20, at least 21, at least 22, at least 23, at least 24, at least 25, at least 30, at least 35, at least 40, at least 45, at least 50, at least 55 or more than 60 TEE sequences. In one embodiment, the 5'UTR of a polynucleotide of the present disclosure can include 1-60, 1-55, 1-50, 1-45, 1-40, 1-35, 1-30, 1-25, 1-20, 1-15, 1-10, 9, 8, 7, 6, 5, 4, 3, 2, or 1 TEE sequences. The TEE sequences in the 5'UTR of the polynucleotide of the present disclosure can be the same or different TEE sequences. A combination of different TEE sequences in the 5'UTR of the polynucleotide of the present disclosure can include combinations in which more than one copy of any of the different TEE sequences are incorporated.

In some embodiments, the 5'UTR and/or 3'UTR comprises a spacer to separate two TEE sequences. As a non-limiting example, the spacer can be a 15 nucleotide spacer and/or other spacers known in the art. As another non-limiting example, the 5'UTR and/or 3'UTR comprises a TEE sequence-spacer module repeated at least once, at least twice, at least 3 times, at least 4 times, at least 5 times, at least 6 times, at least 7 times, at least 8 times, at least 9 times, at least 10 times, or more than 10 times in the 5'UTR and/or 3'UTR, respectively. In some embodiments, the 5'UTR and/or 3'UTR comprises a TEE sequence-spacer module repeated 1, 2, 3, 4, 5, 6, 7, 8, 9, or 10 times.

In some embodiments, the spacer separating two TEE sequences can include other sequences known in the art that can regulate the translation of the polynucleotide of the present disclosure, e.g., miR binding site sequences described herein (e.g., miR binding sites and miR seeds). As a non-limiting example, each spacer used to separate two TEE sequences can include a different miR binding site sequence or component of a miR binding site sequence (e.g., miR seed sequence).

In some embodiments, a polynucleotide of the present disclosure comprises a miR binding site and/or TEE sequence. In some embodiments, the incorporation of a miR binding site sequence and/or a TEE sequence into a polynucleotide of the present disclosure can change the shape of the stem loop region, which can increase and/or decrease translation. See e.g., Kedde et al., Nature Cell Biology 2010 12(10):1014-20, herein incorporated by reference in its entirety).

12. MicroRNA (miRNA) Binding Sites

Polynucleotides of the present disclosure can include regulatory elements, for example, microRNA (miRNA) binding sites, transcription factor binding sites, structured mRNA sequences and/or motifs, artificial binding sites engineered to act as pseudo-receptors for endogenous nucleic acid binding molecules, and combinations thereof. In some embodiments, polynucleotides including such regulatory elements are referred to as including "sensor sequences". Non-limiting examples of sensor sequences are described in U.S. Publication 2014/0200261, the contents of which are incorporated herein by reference in their entirety.

In some embodiments, a polynucleotide (e.g., a ribonucleic acid (RNA), e.g., a messenger RNA (mRNA)) of the present disclosure comprises an open reading frame (ORF) encoding a polypeptide of interest and further comprises one or more miRNA binding site(s). Inclusion or incorporation of miRNA binding site(s) provides for regulation of polynucleotides of the present disclosure, and in turn, of the polypeptides encoded therefrom, based on tissue-specific and/or cell-type specific expression of naturally-occurring miRNAs.

A miRNA binding site, e.g., a natural-occurring miRNA binding site, is a 19-25 nucleotide long noncoding RNA that binds to a polynucleotide and down-regulates gene expression either by reducing stability or by inhibiting translation of the polynucleotide. A miRNA sequence comprises a "seed" region, i.e., a sequence in the region of positions 2-8 of the mature miRNA. A miRNA seed can comprise positions 2-8 or 2-7 of the mature miRNA. In some embodiments, a miRNA seed can comprise 7 nucleotides (e.g., nucleotides 2-8 of the mature miRNA), wherein the seed-complementary site in the corresponding miRNA binding site is flanked by an adenosine (A) opposed to miRNA position 1. In some embodiments, a miRNA seed can comprise 6 nucleotides (e.g., nucleotides 2-7 of the mature miRNA), wherein the seed-complementary site in the corresponding miRNA binding site is flanked by an adenosine (A) opposed to miRNA position 1. See, for example, Grimson A, Farh K K, Johnston W K, Garrett-Engele P, Lim L P, Bartel D P; Mol Cell. 2007 Jul. 6; 27(1):91-105. miRNA profiling of the target cells or tissues can be conducted to determine the presence or absence of miRNA in the cells or tissues. In some embodiments, a polynucleotide (e.g., a ribonucleic acid (RNA), e.g., a messenger RNA (mRNA)) of the present disclosure comprises one or more microRNA binding sites, microRNA target sequences, microRNA complementary sequences, or microRNA seed complementary sequences. Such sequences can correspond to, e.g., have complementarity to, any known microRNA such as those taught in US Publication US2005/0261218 and US Publication US2005/0059005, the contents of each of which are incorporated herein by reference in their entirety.

As used herein, the term "microRNA (miRNA or miR) binding site" refers to a sequence within a polynucleotide, e.g., within a DNA or within an RNA transcript, including in the 5'UTR and/or 3'UTR, that has sufficient complementarity to all or a region of a miRNA to interact with, associate with or bind to the miRNA. In some embodiments, a polynucleotide of the present disclosure comprising an ORF encoding a polypeptide of interest and further comprises one or more miRNA binding site(s). In exemplary embodiments, a 5'UTR and/or 3'UTR of the polynucleotide (e.g., a ribonucleic acid (RNA), e.g., a messenger RNA (mRNA)) comprises the one or more miRNA binding site(s).

A miRNA binding site having sufficient complementarity to a miRNA refers to a degree of complementarity sufficient to facilitate miRNA-mediated regulation of a polynucleotide, e.g., miRNA-mediated translational repression or degradation of the polynucleotide. In exemplary aspects of the present disclosure, a miRNA binding site having sufficient complementarity to the miRNA refers to a degree of complementarity sufficient to facilitate miRNA-mediated degradation of the polynucleotide, e.g., miRNA-guided RNA-induced silencing complex (RISC)-mediated cleavage of mRNA. The miRNA binding site can have complementarity to, for example, a 19-25 nucleotide miRNA sequence, to a 19-23 nucleotide miRNA sequence, or to a 22 nucleotide miRNA sequence. A miRNA binding site can be complementary to only a portion of a miRNA, e.g., to a portion less than 1, 2, 3, or 4 nucleotides of the full length of a naturally-occurring miRNA sequence. Full or complete complementarity (e.g., full complementarity or complete complementarity over all or a significant portion of the length of a naturally-occurring miRNA) is preferred when the desired regulation is mRNA degradation.

In some embodiments, a miRNA binding site includes a sequence that has complementarity (e.g., partial or complete complementarity) with an miRNA seed sequence. In some embodiments, the miRNA binding site includes a sequence that has complete complementarity with a miRNA seed sequence. In some embodiments, a miRNA binding site includes a sequence that has complementarity (e.g., partial or complete complementarity) with an miRNA sequence. In some embodiments, the miRNA binding site includes a sequence that has complete complementarity with a miRNA sequence. In some embodiments, a miRNA binding site has complete complementarity with a miRNA sequence but for 1, 2, or 3 nucleotide substitutions, terminal additions, and/or truncations.

In some embodiments, the miRNA binding site is the same length as the corresponding miRNA. In other embodiments, the miRNA binding site is one, two, three, four, five, six, seven, eight, nine, ten, eleven or twelve nucleotide(s) shorter than the corresponding miRNA at the 5' terminus, the 3' terminus, or both. In still other embodiments, the microRNA binding site is two nucleotides shorter than the corresponding microRNA at the 5' terminus, the 3' terminus, or both. The miRNA binding sites that are shorter than the corresponding miRNAs are still capable of degrading the mRNA incorporating one or more of the miRNA binding sites or preventing the mRNA from translation.

In some embodiments, the miRNA binding site binds the corresponding mature miRNA that is part of an active RISC containing Dicer. In another embodiment, binding of the miRNA binding site to the corresponding miRNA in RISC degrades the mRNA containing the miRNA binding site or prevents the mRNA from being translated. In some embodiments, the miRNA binding site has sufficient complementarity to miRNA so that a RISC complex comprising the miRNA cleaves the polynucleotide comprising the miRNA binding site. In other embodiments, the miRNA binding site has imperfect complementarity so that a RISC complex comprising the miRNA induces instability in the polynucleotide comprising the miRNA binding site. In another embodiment, the miRNA binding site has imperfect complementarity so that a RISC complex comprising the miRNA represses transcription of the polynucleotide comprising the miRNA binding site.

In some embodiments, the miRNA binding site has one, two, three, four, five, six, seven, eight, nine, ten, eleven or twelve mismatch(es) from the corresponding miRNA.

In some embodiments, the miRNA binding site has at least about ten, at least about eleven, at least about twelve, at least about thirteen, at least about fourteen, at least about fifteen, at least about sixteen, at least about seventeen, at least about eighteen, at least about nineteen, at least about twenty, or at least about twenty-one contiguous nucleotides complementary to at least about ten, at least about eleven, at least about twelve, at least about thirteen, at least about fourteen, at least about fifteen, at least about sixteen, at least about seventeen, at least about eighteen, at least about nineteen, at least about twenty, or at least about twenty-one, respectively, contiguous nucleotides of the corresponding miRNA.

By engineering one or more miRNA binding sites into a polynucleotide of the present disclosure, the polynucleotide can be targeted for degradation or reduced translation, provided the miRNA in question is available. This can reduce off-target effects upon delivery of the polynucleotide. For example, if a polynucleotide of the present disclosure is not intended to be delivered to a tissue or cell but ends up is said tissue or cell, then a miRNA abundant in the tissue or cell can inhibit the expression of the gene of interest if one or multiple binding sites of the miRNA are engineered into the 5'UTR and/or 3'UTR of the polynucleotide.

Conversely, miRNA binding sites can be removed from polynucleotide sequences in which they naturally occur in order to increase protein expression in specific tissues. For example, a binding site for a specific miRNA can be removed from a polynucleotide to improve protein expression in tissues or cells containing the miRNA.

In one embodiment, a polynucleotide of the present disclosure can include at least one miRNA-binding site in the 5'UTR and/or 3'UTR in order to regulate cytotoxic or cytoprotective mRNA therapeutics to specific cells such as, but not limited to, normal and/or cancerous cells. In another embodiment, a polynucleotide of the present disclosure can include two, three, four, five, six, seven, eight, nine, ten, or more miRNA-binding sites in the 5'-UTR and/or 3'-UTR in order to regulate cytotoxic or cytoprotective mRNA therapeutics to specific cells such as, but not limited to, normal and/or cancerous cells.

Regulation of expression in multiple tissues can be accomplished through introduction or removal of one or more miRNA binding sites, e.g., one or more distinct miRNA binding sites. The decision whether to remove or insert a miRNA binding site can be made based on miRNA expression patterns and/or their profilings in tissues and/or cells in development and/or disease. Identification of miRNAs, miRNA binding sites, and their expression patterns and role in biology have been reported (e.g., Bonauer et al., Curr Drug Targets 2010 11:943-949; Anand and Cheresh Curr Opin Hematol 2011 18:171-176; Contreras and Rao Leukemia 2012 26:404-413 (2011 Dec. 20. doi: 10.1038/leu.2011.356); Bartel Cell 2009 136:215-233; Landgraf et al, Cell, 2007 129:1401-1414; Gentner and Naldini, Tissue Antigens. 2012 80:393-403 and all references therein; each of which is incorporated herein by reference in its entirety).

miRNAs and miRNA binding sites can correspond to any known sequence, including non-limiting examples described in U.S. Publication Nos. 2014/0200261, 2005/0261218, and 2005/0059005, each of which are incorporated herein by reference in their entirety.

Examples of tissues where miRNA are known to regulate mRNA, and thereby protein expression, include, but are not limited to, liver (miR-122), muscle (miR-133, miR-206, miR-208), endothelial cells (miR-17-92, miR-126), myeloid cells (miR-142-3p, miR-142-5p, miR-16, miR-21, miR-223, miR-24, miR-27), adipose tissue (let-7, miR-30c), heart (miR-1d, miR-149), kidney (miR-192, miR-194, miR-204), and lung epithelial cells (let-7, miR-133, miR-126).

Specifically, miRNAs are known to be differentially expressed in immune cells (also called hematopoietic cells), such as antigen presenting cells (APCs) (e.g., dendritic cells and macrophages), macrophages, monocytes, B lymphocytes, T lymphocytes, granulocytes, natural killer cells, etc. Immune cell specific miRNAs are involved in immunogenicity, autoimmunity, the immune-response to infection, inflammation, as well as unwanted immune response after gene therapy and tissue/organ transplantation. Immune cells specific miRNAs also regulate many aspects of development, proliferation, differentiation and apoptosis of hematopoietic cells (immune cells). For example, miR-142 and miR-146 are exclusively expressed in immune cells, particularly abundant in myeloid dendritic cells. It has been demonstrated that the immune response to a polynucleotide can be shut-off by adding miR-142 binding sites to the 3'-UTR of the polynucleotide, enabling more stable gene transfer in tissues and cells. miR-142 efficiently degrades exogenous polynucleotides in antigen presenting cells and suppresses cytotoxic elimination of transduced cells (e.g., Annoni A et al., blood, 2009, 114, 5152-5161; Brown B D, et al., Nat med. 2006, 12(5), 585-591; Brown B D, et al., blood, 2007, 110(13): 4144-4152, each of which is incorporated herein by reference in its entirety).

An antigen-mediated immune response can refer to an immune response triggered by foreign antigens, which, when entering an organism, are processed by the antigen presenting cells and displayed on the surface of the antigen presenting cells. T cells can recognize the presented antigen and induce a cytotoxic elimination of cells that express the antigen.

Introducing a miR-142 binding site into the 5'UTR and/or 3'UTR of a polynucleotide of the present disclosure can selectively repress gene expression in antigen presenting cells through miR-142 mediated degradation, limiting antigen presentation in antigen presenting cells (e.g., dendritic cells) and thereby preventing antigen-mediated immune response after the delivery of the polynucleotide. The polynucleotide is then stably expressed in target tissues or cells without triggering cytotoxic elimination.

In one embodiment, binding sites for miRNAs that are known to be expressed in immune cells, in particular, antigen presenting cells, can be engineered into a polynucleotide of the present disclosure to suppress the expression of the polynucleotide in antigen presenting cells through miRNA mediated RNA degradation, subduing the antigen-mediated immune response. Expression of the polynucleotide is maintained in non-immune cells where the immune cell specific miRNAs are not expressed. For example, in some embodiments, to prevent an immunogenic reaction against a liver specific protein, any miR-122 binding site can be removed and a miR-142 (and/or mirR-146) binding site can be engineered into the 5'UTR and/or 3'UTR of a polynucleotide of the present disclosure.

To further drive the selective degradation and suppression in APCs and macrophage, a polynucleotide of the present disclosure can include a further negative regulatory element in the 5'UTR and/or 3'UTR, either alone or in combination with miR-142 and/or miR-146 binding sites. As a non-limiting example, the further negative regulatory element is a Constitutive Decay Element (CDE).

Immune cell specific miRNAs include, but are not limited to, hsa-let-7a-2-3p, hsa-let-7a-3p, hsa-7a-5p, hsa-let-7c, hsa-let-7e-3p, hsa-let-7e-5p, hsa-let-7g-3p, hsa-let-7g-5p, hsa-let-7i-3p, hsa-let-7i-5p, miR-10a-3p, miR-10a-5p, miR-1184, hsa-let-7f-1-3p, hsa-let-7f-2-5p, hsa-let-7f-5p, miR-125b-1-3p, miR-125b-2-3p, miR-125b-5p, miR-1279, miR-130a-3p, miR-130a-5p, miR-132-3p, miR-132-5p, miR-142-3p, miR-142-5p, miR-143-3p, miR-143-5p, miR-146a-3p, miR-146a-5p, miR-146b-3p, miR-146b-5p, miR-147a, miR-147b, miR-148a-5p, miR-148a-3p, miR-150-3p, miR-150-5p, miR-151b, miR-155-3p, miR-155-5p, miR-15a-3p, miR-15a-5p, miR-15b-5p, miR-15b-3p, miR-16-1-3p, miR-16-2-3p, miR-16-5p, miR-17-5p, miR-181a-3p, miR-181a-5p, miR-181a-2-3p, miR-182-3p, miR-182-5p, miR-197-3p, miR-197-5p, miR-21-5p, miR-21-3p, miR-214-3p, miR-214-5p, miR-223-3p, miR-223-5p, miR-221-3p, miR-221-5p, miR-23b-3p, miR-23b-5p, miR-24-1-5p, miR-24-2-5p, miR-24-3p, miR-26a-1-3p, miR-26a-2-3p, miR-26a-5p, miR-26b-3p, miR-26b-5p, miR-27a-3p, miR-27a-5p, miR-27b-3p, miR-27b-5p, miR-28-3p, miR-28-5p, miR-2909, miR-29a-3p, miR-29a-5p, miR-29b-1-5p, miR-29b-2-5p, miR-29c-3p, miR-29c-5p, miR-30e-3p, miR-30e-5p, miR-331-5p, miR-339-3p, miR-339-5p, miR-345-3p, miR-345-5p, miR-346, miR-34a-3p, miR-34a-5p, miR-363-3p, miR-363-5p, miR-372, miR-377-3p, miR-377-5p, miR-493-3p, miR-493-5p, miR-542, miR-548b-5p, miR548c-5p, miR-548i, miR-548j, miR-548n, miR-574-3p, miR-598, miR-718, miR-935, miR-99a-3p, miR-99a-5p, miR-99b-3p, and miR-99b-5p. Furthermore, novel miRNAs can be identified in immune cell through micro-array hybridization and microtome analysis (e.g., Jima D D et al, Blood, 2010, 116:e118-e127; Vaz C et al., BMC Genomics, 2010, 11,288, the content of each of which is incorporated herein by reference in its entirety.)

miRNAs that are known to be expressed in the liver include, but are not limited to, miR-107, miR-122-3p, miR-122-5p, miR-1228-3p, miR-1228-5p, miR-1249, miR-129-5p, miR-1303, miR-151a-3p, miR-151a-5p, miR-152, miR-194-3p, miR-194-5p, miR-199a-3p, miR-199a-5p, miR-199b-3p, miR-199b-5p, miR-296-5p, miR-557, miR-581, miR-939-3p, and miR-939-5p. MiRNA binding sites from any liver specific miRNA can be introduced to or removed from a polynucleotide of the present disclosure to regulate expression of the polynucleotide in the liver. Liver specific miRNA binding sites can be engineered alone or further in combination with immune cell (e.g., APC) miRNA binding sites in a polynucleotide of the present disclosure.

miRNAs that are known to be expressed in the lung include, but are not limited to, let-7a-2-3p, let-7a-3p, let-7a-5p, miR-126-3p, miR-126-5p, miR-127-3p, miR-127-5p, miR-130a-3p, miR-130a-5p, miR-130b-3p, miR-130b-5p, miR-133a, miR-133b, miR-134, miR-18a-3p, miR-18a-5p, miR-18b-3p, miR-18b-5p, miR-24-1-5p, miR-24-2-5p, miR-24-3p, miR-296-3p, miR-296-5p, miR-32-3p, miR-337-3p, miR-337-5p, miR-381-3p, and miR-381-5p. miRNA binding sites from any lung specific miRNA can be introduced to or removed from a polynucleotide of the present disclosure to regulate expression of the polynucleotide in the lung. Lung specific miRNA binding sites can be engineered alone or further in combination with immune cell (e.g., APC) miRNA binding sites in a polynucleotide of the present disclosure.

miRNAs that are known to be expressed in the heart include, but are not limited to, miR-1, miR-133a, miR-133b, miR-149-3p, miR-149-5p, miR-186-3p, miR-186-5p, miR-208a, miR-208b, miR-210, miR-296-3p, miR-320, miR-451a, miR-451b, miR-499a-3p, miR-499a-5p, miR-499b-3p, miR-499b-5p, miR-744-3p, miR-744-5p, miR-92b-3p, and miR-92b-5p. mMiRNA binding sites from any heart specific microRNA can be introduced to or removed from a polynucleotide of the present disclosure to regulate expression of the polynucleotide in the heart. Heart specific miRNA binding sites can be engineered alone or further in combination with immune cell (e.g., APC) miRNA binding sites in a polynucleotide of the present disclosure.

miRNAs that are known to be expressed in the nervous system include, but are not limited to, miR-124-5p, miR-125a-3p, miR-125a-5p, miR-125b-1-3p, miR-125b-2-3p, miR-125b-5p,miR-1271-3p, miR-1271-5p, miR-128, miR-132-5p, miR-135a-3p, miR-135a-5p, miR-135b-3p, miR-135b-5p, miR-137, miR-139-5p, miR-139-3p, miR-149-3p, miR-149-5p, miR-153, miR-181c-3p, miR-181c-5p, miR-183-3p, miR-183-5p, miR-190a, miR-190b, miR-212-3p, miR-212-5p, miR-219-1-3p, miR-219-2-3p, miR-23a-3p, miR-23a-5p, miR-30a-5p, miR-30b-3p, miR-30b-5p, miR-30c-1-3p, miR-30c-2-3p, miR-30c-5p, miR-30d-3p, miR-30d-5p, miR-329, miR-342-3p, miR-3665, miR-3666, miR-380-3p, miR-380-5p, miR-383, miR-410, miR-425-3p, miR-425-5p, miR-454-3p, miR-454-5p, miR-483, miR-510, miR-516a-3p, miR-548b-5p, miR-548c-5p, miR-571, miR-7-1-3p, miR-7-2-3p, miR-7-5p, miR-802, miR-922, miR-9-

3p, and miR-9-5p. miRNAs enriched in the nervous system further include those specifically expressed in neurons, including, but not limited to, miR-132-3p, miR-132-3p, miR-148b-3p, miR-148b-5p, miR-151a-3p, miR-151a-5p, miR-212-3p, miR-212-5p, miR-320b, miR-320e, miR-323a-3p, miR-323a-5p, miR-324-5p, miR-325, miR-326, miR-328, miR-922 and those specifically expressed in glial cells, including, but not limited to, miR-1250, miR-219-1-3p, miR-219-2-3p, miR-219-5p, miR-23a-3p, miR-23a-5p, miR-3065-3p, miR-3065-5p, miR-30e-3p, miR-30e-5p, miR-32-5p, miR-338-5p, and miR-657. miRNA binding sites from any CNS specific miRNA can be introduced to or removed from a polynucleotide of the present disclosure to regulate expression of the polynucleotide in the nervous system. Nervous system specific miRNA binding sites can be engineered alone or further in combination with immune cell (e.g., APC) miRNA binding sites in a polynucleotide of the present disclosure.

miRNAs that are known to be expressed in the pancreas include, but are not limited to, miR-105-3p, miR-105-5p, miR-184, miR-195-3p, miR-195-5p, miR-196a-3p, miR-196a-5p, miR-214-3p, miR-214-5p, miR-216a-3p, miR-216a-5p, miR-30a-3p, miR-33a-3p, miR-33a-5p, miR-375, miR-7-1-3p, miR-7-2-3p, miR-493-3p, miR-493-5p, and miR-944. MiRNA binding sites from any pancreas specific miRNA can be introduced to or removed from a polynucleotide of the present disclosure to regulate expression of the polynucleotide in the pancreas. Pancreas specific miRNA binding sites can be engineered alone or further in combination with immune cell (e.g. APC) miRNA binding sites in a polynucleotide of the present disclosure.

miRNAs that are known to be expressed in the kidney include, but are not limited to, miR-122-3p, miR-145-5p, miR-17-5p, miR-192-3p, miR-192-5p, miR-194-3p, miR-194-5p, miR-20a-3p, miR-20a-5p, miR-204-3p, miR-204-5p, miR-210, miR-216a-3p, miR-216a-5p, miR-296-3p, miR-30a-3p, miR-30a-5p, miR-30b-3p, miR-30b-5p, miR-30c-1-3p, miR-30c-2-3p, miR30c-5p, miR-324-3p, miR-335-3p, miR-335-5p, miR-363-3p, miR-363-5p, and miR-562. miRNA binding sites from any kidney specific miRNA can be introduced to or removed from a polynucleotide of the present disclosure to regulate expression of the polynucleotide in the kidney. Kidney specific miRNA binding sites can be engineered alone or further in combination with immune cell (e.g., APC) miRNA binding sites in a polynucleotide of the present disclosure.

miRNAs that are known to be expressed in the muscle include, but are not limited to, let-7g-3p, let-7g-5p, miR-1, miR-1286, miR-133a, miR-133b, miR-140-3p, miR-143-3p, miR-143-5p, miR-145-3p, miR-145-5p, miR-188-3p, miR-188-5p, miR-206, miR-208a, miR-208b, miR-25-3p, and miR-25-5p. MiRNA binding sites from any muscle specific miRNA can be introduced to or removed from a polynucleotide of the present disclosure to regulate expression of the polynucleotide in the muscle. Muscle specific miRNA binding sites can be engineered alone or further in combination with immune cell (e.g., APC) miRNA binding sites in a polynucleotide of the present disclosure.

miRNAs are also differentially expressed in different types of cells, such as, but not limited to, endothelial cells, epithelial cells, and adipocytes.

miRNAs that are known to be expressed in endothelial cells include, but are not limited to, let-7b-3p, let-7b-5p, miR-100-3p, miR-100-5p, miR-101-3p, miR-101-5p, miR-126-3p, miR-126-5p, miR-1236-3p, miR-1236-5p, miR-130a-3p, miR-130a-5p, miR-17-5p, miR-17-3p, miR-18a-3p, miR-18a-5p, miR-19a-3p, miR-19a-5p, miR-19b-1-5p, miR-19b-2-5p, miR-19b-3p, miR-20a-3p, miR-20a-5p, miR-217, miR-210, miR-21-3p, miR-21-5p, miR-221-3p, miR-221-5p, miR-222-3p, miR-222-5p, miR-23a-3p, miR-23a-5p, miR-296-5p, miR-361-3p, miR-361-5p, miR-421, miR-424-3p, miR-424-5p, miR-513a-5p, miR-92a-1-5p, miR-92a-2-5p, miR-92a-3p, miR-92b-3p, and miR-92b-5p. Many novel miRNAs are discovered in endothelial cells from deep-sequencing analysis (e.g., Voellenkle C et al., RNA, 2012, 18, 472-484, herein incorporated by reference in its entirety). miRNA binding sites from any endothelial cell specific miRNA can be introduced to or removed from a polynucleotide of the present disclosure to regulate expression of the polynucleotide in the endothelial cells.

miRNAs that are known to be expressed in epithelial cells include, but are not limited to, let-7b-3p, let-7b-5p, miR-1246, miR-200a-3p, miR-200a-5p, miR-200b-3p, miR-200b-5p, miR-200c-3p, miR-200c-5p, miR-338-3p, miR-429, miR-451a, miR-451b, miR-494, miR-802 and miR-34a, miR-34b-5p, miR-34c-5p, miR-449a, miR-449b-3p, miR-449b-5p specific in respiratory ciliated epithelial cells, let-7 family, miR-133a, miR-133b, miR-126 specific in lung epithelial cells, miR-382-3p, miR-382-5p specific in renal epithelial cells, and miR-762 specific in corneal epithelial cells. miRNA binding sites from any epithelial cell specific miRNA can be introduced to or removed from a polynucleotide of the present disclosure to regulate expression of the polynucleotide in the epithelial cells.

In addition, a large group of miRNAs are enriched in embryonic stem cells, controlling stem cell self-renewal as well as the development and/or differentiation of various cell lineages, such as neural cells, cardiac, hematopoietic cells, skin cells, osteogenic cells and muscle cells (e.g., Kuppusamy K T et al., Curr. Mol Med, 2013, 13(5), 757-764; Vidigal J A and Ventura A, Semin Cancer Biol. 2012, 22(5-6), 428-436; Goff L A et al., PLoS One, 2009, 4:e7192; Morin R D et al., Genome Res,2008,18, 610-621; Yoo J K et al., Stem Cells Dev. 2012, 21(11), 2049-2057, each of which is herein incorporated by reference in its entirety). MiRNAs abundant in embryonic stem cells include, but are not limited to, let-7a-2-3p, let-α-3p, let-7a-5p, let7d-3p, let-7d-5p, miR-103a-2-3p, miR-103a-5p, miR-106b-3p, miR-106b-5p, miR-1246, miR-1275, miR-138-1-3p, miR-138-2-3p, miR-138-5p, miR-154-3p, miR-154-5p, miR-200c-3p, miR-200c-5p, miR-290, miR-301a-3p, miR-301a-5p, miR-302a-3p, miR-302a-5p, miR-302b-3p, miR-302b-5p, miR-302c-3p, miR-302c-5p, miR-302d-3p, miR-302d-5p, miR-302e, miR-367-3p, miR-367-5p, miR-369-3p, miR-369-5p, miR-370, miR-371, miR-373, miR-380-5p, miR-423-3p, miR-423-5p, miR-486-5p, miR-520c-3p, miR-548e, miR-548f, miR-548g-3p, miR-548g-5p, miR-548i, miR-548k, miR-548l, miR-548m, miR-548n, miR-5480-3p, miR-5480-5p, miR-548p, miR-664a-3p, miR-664a-5p, miR-664b-3p, miR-664b-5p, miR-766-3p, miR-766-5p, miR-885-3p, miR-885-5p, miR-93-3p, miR-93-5p, miR-941, miR-96-3p, miR-96-5p, miR-99b-3p and miR-99b-5p. Many predicted novel miRNAs are discovered by deep sequencing in human embryonic stem cells (e.g., Morin R D et al., Genome Res,2008, 18, 610-621; Goff L A et al., PLoS One, 2009, 4:e7192; Bar M et al., Stem cells, 2008, 26, 2496-2505, the content of each of which is incorporated herein by reference in its entirety).

In one embodiment, the binding sites of embryonic stem cell specific miRNAs can be included in or removed from the 3'UTR of a polynucleotide of the present disclosure to modulate the development and/or differentiation of embryonic stem cells, to inhibit the senescence of stem cells in a degenerative condition (e.g. degenerative diseases), or to stimulate the senescence and apoptosis of stem cells in a disease condition (e.g. cancer stem cells).

As a non-limiting example, miRNA binding sites for miRNAs that are over-expressed in certain cancer and/or tumor cells can be removed from the 3'UTR of a polynucleotide of the present disclosure, restoring the expression suppressed by the over-expressed miRNAs in cancer cells, thus ameliorating the corresponsive biological function, for instance, transcription stimulation and/or repression, cell cycle arrest, apoptosis and cell death. Normal cells and tissues, wherein miRNAs expression is not up-regulated, will remain unaffected.

miRNA can also regulate complex biological processes such as angiogenesis (e.g., miR-132) (Anand and Cheresh Curr Opin Hematol 2011 18:171-176). In the polynucleotides of the present disclosure, miRNA binding sites that are involved in such processes can be removed or introduced, in order to tailor the expression of the polynucleotides to biologically relevant cell types or relevant biological processes. In this context, the polynucleotides of the present disclosure are defined as auxotrophic polynucleotides.

In some embodiments, a polynucleotide of the present disclosure comprises a miRNA binding site, wherein the miRNA binding site comprises one or more nucleotide sequences selected from TABLE 4, including one or more copies of any one or more of the miRNA binding site sequences. In some embodiments, a polynucleotide of the present disclosure further comprises at least one, two, three, four, five, six, seven, eight, nine, ten, or more of the same or different miRNA binding sites selected from TABLE 4, including any combination thereof. In some embodiments, the miRNA binding site binds to miR-142 or is complementary to miR-142. In some embodiments, the miR-142 comprises SEQ ID NO:98. In some embodiments, the miRNA binding site binds to miR-142-3p or miR-142-5p. In some embodiments, the miR-142-3p binding site comprises SEQ ID NO:100. In some embodiments, the miR-142-5p binding site comprises SEQ ID NO:102. In some embodiments, the miRNA binding site comprises a nucleotide sequence at least 80%, at least 85%, at least 90%, at least 95%, or 100% identical to SEQ ID NO:100 or SEQ ID NO:102.

TABLE 4 miR-142 and miR-142 binding sites

| SEQ ID NO. | Description | Sequence |
|---|---|---|
| 98 | miR-142 | GACAGUGCAGUCACCCAUAAAGUAGA AAGCACUACUAACAGCACUGGAGGGU GUAGUGUUUCCUACUUUAUGGAUGAG UGUACUGUG |
| 99 | miR-142-3p | UGUAGUGUUUCCUACUUUAUGGA |
| 100 | miR-142-3p binding site | UCCAUAAAGUAGGAAACACUACA |
| 101 | miR-142-5p | CAUAAAGUAGAAAGCACUACU |
| 102 | miR-142-5p binding site | AGUAGUGCUUUCUACUUUAUG |

In some embodiments, a miRNA binding site is inserted in the polynucleotide of the present disclosure in any position of the polynucleotide (e.g., the 5'UTR and/or 3'UTR). In some embodiments, the 5'UTR comprises a miRNA binding site. In some embodiments, the 3'UTR comprises a miRNA binding site. In some embodiments, the 5'UTR and the 3'UTR comprise a miRNA binding site. The insertion site in the polynucleotide can be anywhere in the polynucleotide as long as the insertion of the miRNA binding site in the polynucleotide does not interfere with the translation of a functional polypeptide in the absence of the corresponding miRNA; and in the presence of the miRNA, the insertion of the miRNA binding site in the polynucleotide and the binding of the miRNA binding site to the corresponding miRNA are capable of degrading the polynucleotide or preventing the translation of the polynucleotide.

In some embodiments, a miRNA binding site is inserted in at least about 30 nucleotides downstream from the stop codon of an ORF in a polynucleotide of the present disclosure comprising the ORF. In some embodiments, a miRNA binding site is inserted in at least about 10 nucleotides, at least about 15 nucleotides, at least about 20 nucleotides, at least about 25 nucleotides, at least about 30 nucleotides, at least about 35 nucleotides, at least about 40 nucleotides, at least about 45 nucleotides, at least about 50 nucleotides, at least about 55 nucleotides, at least about 60 nucleotides, at least about 65 nucleotides, at least about 70 nucleotides, at least about 75 nucleotides, at least about 80 nucleotides, at least about 85 nucleotides, at least about 90 nucleotides, at least about 95 nucleotides, or at least about 100 nucleotides downstream from the stop codon of an ORF in a polynucleotide of the present disclosure. In some embodiments, a miRNA binding site is inserted in about 10 nucleotides to about 100 nucleotides, about 20 nucleotides to about 90 nucleotides, about 30 nucleotides to about 80 nucleotides, about 40 nucleotides to about 70 nucleotides, about 50 nucleotides to about 60 nucleotides, about 45 nucleotides to about 65 nucleotides downstream from the stop codon of an ORF in a polynucleotide of the present disclosure.

miRNA gene regulation can be influenced by the sequence surrounding the miRNA such as, but not limited to, the species of the surrounding sequence, the type of sequence (e.g., heterologous, homologous, exogenous, endogenous, or artificial), regulatory elements in the surrounding sequence and/or structural elements in the surrounding sequence. The miRNA can be influenced by the 5'UTR and/or 3'UTR. As a non-limiting example, a non-human 3'UTR can increase the regulatory effect of the miRNA sequence on the expression of a polypeptide of interest compared to a human 3'UTR of the same sequence type.

In one embodiment, other regulatory elements and/or structural elements of the 5'UTR can influence miRNA mediated gene regulation. One example of a regulatory element and/or structural element is a structured IRES (Internal Ribosome Entry Site) in the 5'UTR, which is necessary for the binding of translational elongation factors to initiate protein translation. EIF4A2 binding to this secondarily structured element in the 5'-UTR is necessary for miRNA mediated gene expression (Meijer H A et al., Science, 2013, 340, 82-85, herein incorporated by reference in its entirety). The polynucleotides of the present disclosure can further include this structured 5'UTR in order to enhance microRNA mediated gene regulation.

At least one miRNA binding site can be engineered into the 3'UTR of a polynucleotide of the present disclosure. In this context, at least two, at least three, at least four, at least five, at least six, at least seven, at least eight, at least nine, at least ten, or more miRNA binding sites can be engineered into a 3'UTR of a polynucleotide of the present disclosure. For example, 1 to 10, 1 to 9, 1 to 8, 1 to 7, 1 to 6, 1 to 5, 1 to 4, 1 to 3, 2, or 1 miRNA binding sites can be engineered into the 3'UTR of a polynucleotide of the present disclosure. In one embodiment, miRNA binding sites incorporated into a polynucleotide of the present disclosure can be the same or can be different miRNA sites. A combination of different miRNA binding sites incorporated into a polynucleotide of the present disclosure can include combinations in which more than one copy of any of the different miRNA sites are incorporated. In another embodiment, miRNA binding sites incorporated into a polynucleotide of the present disclosure can target the same or different tissues in the body. As a non-limiting example, through the introduction of tissue-, cell-type-, or disease-specific miRNA binding sites in the 3'-UTR of a polynucleotide of the present disclosure, the degree of expression in specific cell types (e.g., hepatocytes, myeloid cells, endothelial cells, cancer cells, etc.) can be reduced.

In one embodiment, a miRNA binding site can be engineered near the 5' terminus of the 3'UTR, about halfway between the 5' terminus and 3' terminus of the 3'UTR and/or near the 3' terminus of the 3'UTR in a polynucleotide of the present disclosure. As a non-limiting example, a miRNA binding site can be engineered near the 5' terminus of the 3'UTR and about halfway between the 5' terminus and 3' terminus of the 3'UTR. As another non-limiting example, a miRNA binding site can be engineered near the 3' terminus of the 3'UTR and about halfway between the 5' terminus and 3' terminus of the 3'UTR. As yet another non-limiting example, a miRNA binding site can be engineered near the 5' terminus of the 3'UTR and near the 3' terminus of the 3'UTR.

In another embodiment, a 3'UTR can comprise 1, 2, 3, 4, 5, 6, 7, 8, 9, or 10 miRNA binding sites. The miRNA binding sites can be complementary to a miRNA, miRNA seed sequence, and/or miRNA sequences flanking the seed sequence.

In one embodiment, a polynucleotide of the present disclosure can be engineered to include more than one miRNA site expressed in different tissues or different cell types of a subject. As a non-limiting example, a polynucleotide of the present disclosure can be engineered to include miR-192 and miR-122 to regulate expression of the polynucleotide in the liver and kidneys of a subject. In another embodiment, a polynucleotide of the present disclosure can be engineered to include more than one miRNA site for the same tissue.

In some embodiments, the expression of a polynucleotide of the present disclosure can be controlled by incorporating at least one miR binding site in the polynucleotide and formulating the polynucleotide for administration. As a non-limiting example, a polynucleotide of the present disclosure can be targeted to a tissue or cell by incorporating a miRNA binding site and formulating the polynucleotide in a lipid nanoparticle comprising an ionizable lipid, e.g., an ionizable amino lipid, sometimes referred to in the prior art as an "ionizable cationic lipid," including any of the lipids described herein.

A polynucleotide of the present disclosure can be engineered for more targeted expression in specific tissues, cell types, or biological conditions based on the expression patterns of miRNAs in the different tissues, cell types, or biological conditions. Through introduction of tissue-specific miRNA binding sites, a polynucleotide of the present disclosure can be designed for optimal protein expression in a tissue or cell, or in the context of a biological condition.

In some embodiments, a polynucleotide of the present disclosure can be designed to incorporate miRNA binding sites that either have 100% identity to known miRNA seed sequences or have less than 100% identity to miRNA seed sequences. In some embodiments, a polynucleotide of the present disclosure can be designed to incorporate miRNA binding sites that have at least: 60%, 65%, 70%, 75%, 80%, 85%, 90%, 95%, 96%, 97%, 98%, or 99% identity to known miRNA seed sequences. The miRNA seed sequence can be partially mutated to decrease miRNA binding affinity and as such result in reduced downmodulation of the polynucleotide. In essence, the degree of match or mis-match between the miRNA binding site and the miRNA seed can act as a rheostat to more finely tune the ability of the miRNA to modulate protein expression. In addition, mutation in the non-seed region of a miRNA binding site can also impact the ability of a miRNA to modulate protein expression.

In one embodiment, a miRNA sequence can be incorporated into the loop of a stem loop.

In another embodiment, a miRNA seed sequence can be incorporated in the loop of a stem loop and a miRNA binding site can be incorporated into the 5' or 3' stem of the stem loop.

In one embodiment, a translation enhancer element (TEE) can be incorporated on the 5'end of the stem of a stem loop and a miRNA seed can be incorporated into the stem of the stem loop. In another embodiment, a TEE can be incorporated on the 5' end of the stem of a stem loop, a miRNA seed can be incorporated into the stem of the stem loop and a miRNA binding site can be incorporated into the 3' end of the stem or the sequence after the stem loop. The miRNA seed and the miRNA binding site can be for the same and/or different miRNA sequences.

In one embodiment, the incorporation of a miRNA sequence and/or a TEE sequence changes the shape of the stem loop region which can increase and/or decrease translation. (see e.g., Kedde et al., "A Pumilio-induced RNA structure switch in p27-3'UTR controls miR-221 and miR-22 accessibility." Nature Cell Biology. 2010, incorporated herein by reference in its entirety).

In one embodiment, the 5'-UTR of a polynucleotide of the present disclosure can comprise at least one miRNA sequence. The miRNA sequence can be, but is not limited to, a 19 or 22 nucleotide sequence and/or a miRNA sequence without the seed.

In one embodiment the miRNA sequence in the 5'UTR can be used to stabilize a polynucleotide of the present disclosure described herein.

In another embodiment, a miRNA sequence in the 5'UTR of a polynucleotide of the present disclosure can be used to decrease the accessibility of the site of translation initiation such as, but not limited to a start codon. See, e.g., Matsuda et al., PLoS One. 2010 11(5):e15057; incorporated herein by reference in its entirety, which used antisense locked nucleic acid (LNA) oligonucleotides and exon junction complexes (EJCs) around a start codon (−4 to +37 where the A of the AUG codons is +1) in order to decrease the accessibility to the first start codon (AUG). Matsuda showed that altering the sequence around the start codon with an LNA or EJC affected the efficiency, length and structural stability of a polynucleotide. A polynucleotide of the present disclosure can comprise a miRNA sequence, instead of the LNA or EJC sequence described by Matsuda et al, near the site of translation initiation in order to decrease the accessibility to the site of translation initiation. The site of translation initiation can be prior to, after or within the miRNA sequence. As a non-limiting example, the site of translation initiation can be located within a miRNA sequence such as a seed sequence or binding site. As another non-limiting example, the site of translation initiation can be located within a miR-122 sequence such as the seed sequence or the mir-122 binding site.

In some embodiments, a polynucleotide of the present disclosure can include at least one miRNA in order to dampen the antigen presentation by antigen presenting cells. The miRNA can be the complete miRNA sequence, the miRNA seed sequence, the miRNA sequence without the seed, or a combination thereof. As a non-limiting example, a miRNA incorporated into a polynucleotide of the present disclosure can be specific to the hematopoietic system. As another non-limiting example, a miRNA incorporated into a polynucleotide of the present disclosure to dampen antigen presentation is miR-142-3p.

In some embodiments, a polynucleotide of the present disclosure can include at least one miRNA in order to dampen expression of the encoded polypeptide in a tissue or cell of interest. As a non-limiting example, a polynucleotide of the present disclosure can include at least one miR-122 binding site in order to dampen expression of an encoded polypeptide of interest in the liver. As another non-limiting example a polynucleotide of the present disclosure can include at least one miR-142-3p binding site, miR-142-3p seed sequence, miR-142-3p binding site without the seed, miR-142-5p binding site, miR-142-5p seed sequence, miR-142-5p binding site without the seed, miR-146 binding site, miR-146 seed sequence and/or miR-146 binding site without the seed sequence.

In some embodiments, a polynucleotide of the present disclosure can comprise at least one miRNA binding site in the 3'UTR in order to selectively degrade mRNA therapeutics in the immune cells to subdue unwanted immunogenic reactions caused by therapeutic delivery. As a non-limiting example, the miRNA binding site can make a polynucleotide of the present disclosure more unstable in antigen presenting cells. Non-limiting examples of these miRNAs include mir-142-5p, mir-142-3p, mir-146a-5p, and mir-146-3p.

In one embodiment, a polynucleotide of the present disclosure comprises at least one miRNA sequence in a region of the polynucleotide that can interact with a RNA binding protein.

In some embodiments, the polynucleotide of the present disclosure (e.g., a RNA, e.g., an mRNA) comprising (i) a sequence-optimized nucleotide sequence (e.g., an ORF) encoding a CFTR polypeptide (e.g., the wild-type sequence, functional fragment, or variant thereof) and (ii) a miRNA binding site (e.g., a miRNA binding site that binds to miR-142).

In some embodiments, the polynucleotide of the present disclosure comprises a uracil-modified sequence encoding a CFTR polypeptide disclosed herein and a miRNA binding site disclosed herein, e.g., a miRNA binding site that binds to miR-142. In some embodiments, the uracil-modified sequence encoding a CFTR polypeptide comprises at least one chemically modified nucleobase, e.g., 5-methoxyuracil. In some embodiments, at least 95% of a type of nucleobase (e.g., uricil) in a uracil-modified sequence encoding a CFTR polypeptide of the present disclosure are modified nucleobases. In some embodiments, at least 95% of uricil in a uracil-modified sequence encoding a CFTR polypeptide is 5-methoxyuridine. In some embodiments, the polynucleotide comprising a nucleotide sequence encoding a CFTR polypeptide disclosed herein and a miRNA binding site is formulated with a delivery agent, e.g., a compound having the Formula (I), (IA), (II), (IIa), (IIb), (IIc), (IId) or (IIe), e.g., any of Compounds 1-232.

13. 3' UTRs

In certain embodiments, a polynucleotide of the present disclosure (e.g., a polynucleotide comprising a nucleotide sequence encoding a CFTR polypeptide of the present disclosure) further comprises a 3' UTR.

3'-UTR is the section of mRNA that immediately follows the translation termination codon and often contains regulatory regions that post-transcriptionally influence gene expression. Regulatory regions within the 3'-UTR can influence polyadenylation, translation efficiency, localization, and stability of the mRNA. In one embodiment, the 3'-UTR useful for the present disclosure comprises a binding site for regulatory proteins or microRNAs.

14. Regions Having a 5' Cap

The present disclosure also includes a polynucleotide that comprises both a 5' Cap and a polynucleotide of the present disclosure (e.g., a polynucleotide comprising a nucleotide sequence encoding a CFTR polypeptide).

The 5' cap structure of a natural mRNA is involved in nuclear export, increasing mRNA stability and binds the mRNA Cap Binding Protein (CBP), which is responsible for mRNA stability in the cell and translation competency through the association of CBP with poly(A) binding protein to form the mature cyclic mRNA species. The cap further assists the removal of 5' proximal introns during mRNA splicing.

Endogenous mRNA molecules can be 5'-end capped generating a 5'-ppp-5'-triphosphate linkage between a terminal guanosine cap residue and the 5'-terminal transcribed sense nucleotide of the mRNA molecule. This 5'-guanylate cap can then be methylated to generate an N7-methylguanylate residue. The ribose sugars of the terminal and/or anteterminal transcribed nucleotides of the 5' end of the mRNA can optionally also be 2'-O-methylated. 5'-decapping through hydrolysis and cleavage of the guanylate cap structure can target a nucleic acid molecule, such as an mRNA molecule, for degradation.

In some embodiments, the polynucleotides of the present disclosure (e.g., a polynucleotide comprising a nucleotide sequence encoding a CFTR polypeptide) incorporate a cap moiety.

In some embodiments, polynucleotides of the present disclosure (e.g., a polynucleotide comprising a nucleotide sequence encoding a CFTR polypeptide) comprise a non-hydrolyzable cap structure preventing decapping and thus increasing mRNA half-life. Because cap structure hydrolysis requires cleavage of 5'-ppp-5' phosphorodiester linkages, modified nucleotides can be used during the capping reaction. For example, a Vaccinia Capping Enzyme from New England Biolabs (Ipswich, MA) can be used with α-thio-guanosine nucleotides according to the manufacturer's instructions to create a phosphorothioate linkage in the 5'-ppp-5' cap. Additional modified guanosine nucleotides can be used such as α-methyl-phosphonate and selenophosphate nucleotides.

Additional modifications include, but are not limited to, 2'-O-methylation of the ribose sugars of 5'-terminal and/or 5'-anteterminal nucleotides of the polynucleotide (as mentioned above) on the 2'-hydroxyl group of the sugar ring. Multiple distinct 5'-cap structures can be used to generate the 5'-cap of a nucleic acid molecule, such as a polynucleotide that functions as an mRNA molecule. Cap analogs, which herein are also referred to as synthetic cap analogs, chemical caps, chemical cap analogs, or structural or functional cap analogs, differ from natural (i.e., endogenous, wild-type or physiological) 5'-caps in their chemical structure, while retaining cap function. Cap analogs can be chemically (i.e., non-enzymatically) or enzymatically synthesized and/or linked to the polynucleotides of the present disclosure.

For example, the Anti-Reverse Cap Analog (ARCA) cap contains two guanines linked by a 5'-5'-triphosphate group, wherein one guanine contains an N7 methyl group as well as a 3'-O-methyl group (i.e., N7,3'-O-dimethyl-guanosine-5'-triphosphate-5'-guanosine (m$^7$G-3'mppp-G; which can equivalently be designated 3' O-Me-m7G(5')ppp(5')G). The 3'-O atom of the other, unmodified, guanine becomes linked to the 5'-terminal nucleotide of the capped polynucleotide. The N7- and 3'-O-methlyated guanine provides the terminal moiety of the capped polynucleotide.

Another exemplary cap is mCAP, which is similar to ARCA but has a 2'-O-methyl group on guanosine (i.e., N7,2'-O-dimethyl-guanosine-5'-triphosphate-5'-guanosine, m$^7$Gm-ppp-G).

In some embodiments, the cap is a dinucleotide cap analog. As a non-limiting example, the dinucleotide cap analog can be modified at different phosphate positions with a boranophosphate group or a phophoroselenoate group such as the dinucleotide cap analogs described in U.S. Pat. No. 8,519,110, the contents of which are herein incorporated by reference in its entirety.

In another embodiment, the cap is a cap analog is a N7-(4-chlorophenoxyethyl) substituted dicucleotide form of a cap analog known in the art and/or described herein. Non-limiting examples of a N7-(4-chlorophenoxyethyl) substituted dicucleotide form of a cap analog include a N7-(4-chlorophenoxyethyl)-G(5')ppp(5')G and a N7-(4-chlorophenoxyethyl)-m$^{3'-O}$G(5')ppp(5')G cap analog (See, e.g., the various cap analogs and the methods of synthesizing cap analogs described in Kore et al. Bioorganic & Medicinal Chemistry 2013 21:4570-4574; the contents of which are herein incorporated by reference in its entirety). In another embodiment, a cap analog of the present disclosure is a 4-chloro/bromophenoxyethyl analog.

While cap analogs allow for the concomitant capping of a polynucleotide or a region thereof, in an in vitro transcription reaction, up to 20% of transcripts can remain uncapped. This, as well as the structural differences of a cap analog from an endogenous 5'-cap structures of nucleic acids produced by the endogenous, cellular transcription machinery, can lead to reduced translational competency and reduced cellular stability.

Polynucleotides of the present disclosure (e.g., a polynucleotide comprising a nucleotide sequence encoding a CFTR polypeptide) can also be capped post-manufacture (whether IVT or chemical synthesis), using enzymes, in order to generate more authentic 5'-cap structures. As used herein, the phrase "more authentic" refers to a feature that closely mirrors or mimics, either structurally or functionally, an endogenous or wild type feature. That is, a "more authentic" feature is better representative of an endogenous, wild-type, natural or physiological cellular function and/or structure as compared to synthetic features or analogs, etc., of the prior art, or which outperforms the corresponding endogenous, wild-type, natural or physiological feature in one or more respects. Non-limiting examples of more authentic 5'cap structures of the present disclosure are those that, among other things, have enhanced binding of cap binding proteins, increased half-life, reduced susceptibility to 5' endonucleases and/or reduced 5'decapping, as compared to synthetic 5'cap structures known in the art (or to a wild-type, natural or physiological 5'cap structure). For example, recombinant Vaccinia Virus Capping Enzyme and recombinant 2'-O-methyltransferase enzyme can create a canonical 5'-5'-triphosphate linkage between the 5'-terminal nucleotide of a polynucleotide and a guanine cap nucleotide wherein the cap guanine contains an N7 methylation and the 5'-terminal nucleotide of the mRNA contains a 2'-O-methyl. Such a structure is termed the Cap1 structure. This cap results in a higher translational-competency and cellular stability and a reduced activation of cellular pro-inflammatory cytokines, as compared, e.g., to other 5'cap analog structures known in the art. Cap structures include, but are not limited to, 7mG(5')ppp(5')N,pN2p (cap 0), 7mG(5')ppp(5')NlmpNp (cap 1), and 7mG(5')-ppp(5')N1mpN2mp (cap 2).

As a non-limiting example, capping chimeric polynucleotides post-manufacture can be more efficient as nearly 100% of the chimeric polynucleotides can be capped. This is in contrast to ~80% when a cap analog is linked to a chimeric polynucleotide in the course of an in vitro transcription reaction.

According to the present disclosure, 5' terminal caps can include endogenous caps or cap analogs. According to the present disclosure, a 5' terminal cap can comprise a guanine analog. Useful guanine analogs include, but are not limited to, inosine, N1-methyl-guanosine, 2'fluoro-guanosine, 7-deaza-guanosine, 8-oxo-guanosine, 2-amino-guanosine, LNA-guanosine, and 2-azido-guanosine.

15. Poly-A Tails

In some embodiments, the polynucleotides of the present disclosure (e.g., a polynucleotide comprising a nucleotide sequence encoding a CFTR polypeptide) further comprise a poly-A tail. In further embodiments, terminal groups on the poly-A tail can be incorporated for stabilization. In other embodiments, a poly-A tail comprises des-3' hydroxyl tails.

During RNA processing, a long chain of adenine nucleotides (poly-A tail) can be added to a polynucleotide such as an mRNA molecule in order to increase stability. Immediately after transcription, the 3' end of the transcript can be cleaved to free a 3' hydroxyl. Then poly-A polymerase adds a chain of adenine nucleotides to the RNA. The process, called polyadenylation, adds a poly-A tail that can be between, for example, approximately 80 to approximately 250 residues long, including approximately 80, 90, 100, 110, 120, 130, 140, 150, 160, 170, 180, 190, 200, 210, 220, 230, 240 or 250 residues long.

PolyA tails can also be added after the construct is exported from the nucleus.

According to the present disclosure, terminal groups on the poly A tail can be incorporated for stabilization. Polynucleotides of the present disclosure can include des-3' hydroxyl tails. They can also include structural moieties or 2'-Omethyl modifications as taught by Junjie Li, et al. (Current Biology, Vol. 15, 1501-1507, Aug. 23, 2005, the contents of which are incorporated herein by reference in its entirety).

The polynucleotides of the present disclosure can be designed to encode transcripts with alternative polyA tail structures including histone mRNA. According to Norbury, "Terminal uridylation has also been detected on human replication-dependent histone mRNAs. The turnover of these mRNAs is thought to be important for the prevention of potentially toxic histone accumulation following the completion or inhibition of chromosomal DNA replication. These mRNAs are distinguished by their lack of a 3' poly(A) tail, the function of which is instead assumed by a stable stem-loop structure and its cognate stem-loop binding protein (SLBP); the latter carries out the same functions as those of PABP on polyadenylated mRNAs" (Norbury, "Cytoplasmic RNA: a case of the tail wagging the dog," Nature Reviews Molecular Cell Biology; AOP, published online 29 Aug. 2013; doi:10.1038/nrm3645) the contents of which are incorporated herein by reference in its entirety.

Unique poly-A tail lengths provide certain advantages to the polynucleotides of the present disclosure. Generally, the length of a poly-A tail, when present, is greater than 30 nucleotides in length. In another embodiment, the poly-A tail is greater than 35 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000 nucleotides).

In some embodiments, the polynucleotide or region thereof includes from about 30 to about 3,000 nucleotides (e.g., from 30 to 50, from 30 to 100, from 30 to 250, from 30 to 500, from 30 to 750, from 30 to 1,000, from 30 to 1,500, from 30 to 2,000, from 30 to 2,500, from 50 to 100, from 50 to 250, from 50 to 500, from 50 to 750, from 50 to 1,000, from 50 to 1,500, from 50 to 2,000, from 50 to 2,500, from 50 to 3,000, from 100 to 500, from 100 to 750, from 100 to 1,000, from 100 to 1,500, from 100 to 2,000, from 100 to 2,500, from 100 to 3,000, from 500 to 750, from 500 to 1,000, from 500 to 1,500, from 500 to 2,000, from 500 to 2,500, from 500 to 3,000, from 1,000 to 1,500, from 1,000 to 2,000, from 1,000 to 2,500, from 1,000 to 3,000, from 1,500 to 2,000, from 1,500 to 2,500, from 1,500 to 3,000, from 2,000 to 3,000, from 2,000 to 2,500, and from 2,500 to 3,000).

In some embodiments, the poly-A tail is designed relative to the length of the overall polynucleotide or the length of a particular region of the polynucleotide. This design can be based on the length of a coding region, the length of a particular feature or region or based on the length of the ultimate product expressed from the polynucleotides.

In this context, the poly-A tail can be 10, 20, 30, 40, 50, 60, 70, 80, 90, or 100% greater in length than the polynucleotide or feature thereof. The poly-A tail can also be designed as a fraction of the polynucleotides to which it belongs. In this context, the poly-A tail can be 10, 20, 30, 40, 50, 60, 70, 80, or 90% or more of the total length of the construct, a construct region or the total length of the construct minus the poly-A tail. Further, engineered binding sites and conjugation of polynucleotides for Poly-A binding protein can enhance expression.

Additionally, multiple distinct polynucleotides can be linked together via the PABP (Poly-A binding protein) through the 3'-end using modified nucleotides at the 3'-terminus of the poly-A tail. Transfection experiments can be conducted in relevant cell lines at and protein production can be assayed by ELISA at 12 hr, 24 hr, 48 hr, 72 hr and day 7 post-transfection.

In some embodiments, the polynucleotides of the present disclosure are designed to include a polyA-G Quartet region. The G-quartet is a cyclic hydrogen bonded array of four guanine nucleotides that can be formed by G-rich sequences in both DNA and RNA. In this embodiment, the G-quartet is incorporated at the end of the poly-A tail. The resultant polynucleotide is assayed for stability, protein production and other parameters including half-life at various time points. It has been discovered that the polyA-G quartet results in protein production from an mRNA equivalent to at least 75% of that seen using a poly-A tail of 120 nucleotides alone.

16. Start Codon Region

The present disclosure also includes a polynucleotide that comprises both a start codon region and the polynucleotide described herein (e.g., a polynucleotide comprising a nucleotide sequence encoding a CFTR polypeptide). In some embodiments, the polynucleotides of the present disclosure can have regions that are analogous to or function like a start codon region.

In some embodiments, the translation of a polynucleotide can initiate on a codon that is not the start codon AUG. Translation of the polynucleotide can initiate on an alternative start codon such as, but not limited to, ACG, AGG, AAG, CTG/CUG, GTG/GUG, ATA/AUA, ATT/AUU, TTG/UUG (see Touriol et al. Biology of the Cell 95 (2003) 169-178 and Matsuda and Mauro PLoS ONE, 2010 5:11; the contents of each of which are herein incorporated by reference in its entirety).

As a non-limiting example, the translation of a polynucleotide begins on the alternative start codon ACG. As another non-limiting example, polynucleotide translation begins on the alternative start codon CTG or CUG. As yet another non-limiting example, the translation of a polynucleotide begins on the alternative start codon GTG or GUG.

Nucleotides flanking a codon that initiates translation such as, but not limited to, a start codon or an alternative start codon, are known to affect the translation efficiency, the length and/or the structure of the polynucleotide. (See, e.g., Matsuda and Mauro PLoS ONE, 2010 5:11; the contents of which are herein incorporated by reference in its entirety). Masking any of the nucleotides flanking a codon that initiates translation can be used to alter the position of translation initiation, translation efficiency, length and/or structure of a polynucleotide.

In some embodiments, a masking agent can be used near the start codon or alternative start codon in order to mask or hide the codon to reduce the probability of translation initiation at the masked start codon or alternative start codon. Non-limiting examples of masking agents include antisense locked nucleic acids (LNA) polynucleotides and exon junction complexes (EJCs) (See, e.g., Matsuda and Mauro describing masking agents LNA polynucleotides and EJCs (PLoS ONE, 2010 5:11); the contents of which are herein incorporated by reference in its entirety).

In another embodiment, a masking agent can be used to mask a start codon of a polynucleotide in order to increase the likelihood that translation will initiate on an alternative start codon. In some embodiments, a masking agent can be used to mask a first start codon or alternative start codon in order to increase the chance that translation will initiate on a start codon or alternative start codon downstream to the masked start codon or alternative start codon.

In some embodiments, a start codon or alternative start codon can be located within a perfect complement for a miR binding site. The perfect complement of a miR binding site can help control the translation, length and/or structure of the polynucleotide similar to a masking agent. As a non-limiting example, the start codon or alternative start codon can be located in the middle of a perfect complement for a miRNA binding site. The start codon or alternative start codon can be located after the first nucleotide, second nucleotide, third nucleotide, fourth nucleotide, fifth nucleotide, sixth nucleotide, seventh nucleotide, eighth nucleotide, ninth nucleotide, tenth nucleotide, eleventh nucleotide, twelfth nucleotide, thirteenth nucleotide, fourteenth nucleotide, fifteenth nucleotide, sixteenth nucleotide, seventeenth nucleotide, eighteenth nucleotide, nineteenth nucleotide, twentieth nucleotide or twenty-first nucleotide.

In another embodiment, the start codon of a polynucleotide can be removed from the polynucleotide sequence in order to have the translation of the polynucleotide begin on a codon that is not the start codon. Translation of the polynucleotide can begin on the codon following the removed start codon or on a downstream start codon or an alternative start codon. In a non-limiting example, the start codon ATG or AUG is removed as the first 3 nucleotides of the polynucleotide sequence in order to have translation initiate on a downstream start codon or alternative start codon. The polynucleotide sequence where the start codon was removed can further comprise at least one masking agent for the downstream start codon and/or alternative start codons in order to control or attempt to control the initiation of translation, the length of the polynucleotide and/or the structure of the polynucleotide.

17. Stop Codon Region

The present disclosure also includes a polynucleotide that comprises both a stop codon region and the polynucleotide described herein (e.g., a polynucleotide comprising a nucleotide sequence encoding a CFTR polypeptide). In some embodiments, the polynucleotides of the present disclosure can include at least two stop codons before the 3' untranslated region (UTR). The stop codon can be selected from TGA, TAA and TAG in the case of DNA, or from UGA, UAA and UAG in the case of RNA. In some embodiments, the polynucleotides of the present disclosure include the stop codon TGA in the case or DNA, or the stop codon UGA in the case of RNA, and one additional stop codon. In a further embodiment the addition stop codon can be TAA or UAA. In another embodiment, the polynucleotides of the present disclosure include three consecutive stop codons, four stop codons, or more.

18. Insertions and Substitutions

The present disclosure also includes a polynucleotide of the present disclosure that further comprises insertions and/or substitutions.

In some embodiments, the 5'UTR of the polynucleotide can be replaced by the insertion of at least one region and/or string of nucleosides of the same base. The region and/or string of nucleotides can include, but is not limited to, at least 3, at least 4, at least 5, at least 6, at least 7 or at least 8 nucleotides and the nucleotides can be natural and/or unnatural. As a non-limiting example, the group of nucleotides can include 5-8 adenine, cytosine, thymine, a string of any of the other nucleotides disclosed herein and/or combinations thereof.

In some embodiments, the 5'UTR of the polynucleotide can be replaced by the insertion of at least two regions and/or strings of nucleotides of two different bases such as, but not limited to, adenine, cytosine, thymine, any of the other nucleotides disclosed herein and/or combinations thereof. For example, the 5'UTR can be replaced by inserting 5-8 adenine bases followed by the insertion of 5-8 cytosine bases. In another example, the 5'UTR can be replaced by inserting 5-8 cytosine bases followed by the insertion of 5-8 adenine bases.

In some embodiments, the polynucleotide can include at least one substitution and/or insertion downstream of the transcription start site that can be recognized by an RNA polymerase. As a non-limiting example, at least one substitution and/or insertion can occur downstream of the transcription start site by substituting at least one nucleic acid in the region just downstream of the transcription start site (such as, but not limited to, +1 to +6). Changes to region of nucleotides just downstream of the transcription start site can affect initiation rates, increase apparent nucleotide triphosphate (NTP) reaction constant values, and increase the dissociation of short transcripts from the transcription complex curing initial transcription (Brieba et al, Biochemistry (2002) 41: 5144-5149; herein incorporated by reference in its entirety). The modification, substitution and/or insertion of at least one nucleoside can cause a silent mutation of the sequence or can cause a mutation in the amino acid sequence.

In some embodiments, the polynucleotide can include the substitution of at least 1, at least 2, at least 3, at least 4, at least 5, at least 6, at least 7, at least 8, at least 9, at least 10, at least 11, at least 12 or at least 13 guanine bases downstream of the transcription start site.

In some embodiments, the polynucleotide can include the substitution of at least 1, at least 2, at least 3, at least 4, at least 5 or at least 6 guanine bases in the region just downstream of the transcription start site. As a non-limiting example, if the nucleotides in the region are GGGAGA, the guanine bases can be substituted by at least 1, at least 2, at least 3 or at least 4 adenine nucleotides. In another non-limiting example, if the nucleotides in the region are GGGAGA the guanine bases can be substituted by at least 1, at least 2, at least 3 or at least 4 cytosine bases. In another non-limiting example, if the nucleotides in the region are GGGAGA the guanine bases can be substituted by at least 1, at least 2, at least 3 or at least 4 thymine, and/or any of the nucleotides described herein.

In some embodiments, the polynucleotide can include at least one substitution and/or insertion upstream of the start codon. For the purpose of clarity, one of skill in the art would appreciate that the start codon is the first codon of the protein coding region whereas the transcription start site is the site where transcription begins. The polynucleotide can include, but is not limited to, at least 1, at least 2, at least 3, at least 4, at least 5, at least 6, at least 7 or at least 8 substitutions and/or insertions of nucleotide bases. The nucleotide bases can be inserted or substituted at 1, at least 1, at least 2, at least 3, at least 4 or at least 5 locations upstream of the start codon. The nucleotides inserted and/or substituted can be the same base (e.g., all A or all C or all T or all G), two different bases (e.g., A and C, A and T, or C and T), three different bases (e.g., A, C and T or A, C and T) or at least four different bases.

As a non-limiting example, the guanine base upstream of the coding region in the polynucleotide can be substituted with adenine, cytosine, thymine, or any of the nucleotides described herein. In another non-limiting example the substitution of guanine bases in the polynucleotide can be designed so as to leave one guanine base in the region downstream of the transcription start site and before the start codon (see Esvelt et al. Nature (2011) 472(7344):499-503; the contents of which is herein incorporated by reference in its entirety). As a non-limiting example, at least 5 nucleotides can be inserted at 1 location downstream of the transcription start site but upstream of the start codon and the at least 5 nucleotides can be the same base type.

19. Polynucleotide Comprising an mRNA Encoding a CFTR Polypeptide

In certain embodiments, a polynucleotide of the present disclosure, for example a polynucleotide comprising an mRNA nucleotide sequence encoding a CFTR polypeptide, comprises from 5' to 3' end:
 (i) a 5' cap provided above;
 (ii) a 5' UTR, such as the sequences provided above;
 (iii) an open reading frame encoding a CFTR polypeptide, e.g., a sequence optimized nucleic acid sequence encoding CFTR disclosed herein;
 (iv) at least one stop codon;
 (v) a 3' UTR, such as the sequences provided above; and
 (vi) a poly-A tail provided above.

In some embodiments, the polynucleotide further comprises a miRNA binding site, e.g., a miRNA binding site that binds to miRNA-142. In some embodiments, the 5'UTR comprises the miRNA binding site.

In some embodiments, a polynucleotide of the present disclosure comprises a nucleotide sequence encoding a polypeptide sequence at least 70%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the protein sequence of a wild type CFTR (e.g, isoform 1, 2, 3, or 4).

20. Methods of Making Polynucleotides

The present disclosure also provides methods for making a polynucleotide of the present disclosure (e.g., a polynucleotide comprising a nucleotide sequence encoding a CFTR polypeptide) or a complement thereof.

In some aspects, a polynucleotide (e.g., a RNA, e.g., an mRNA) disclosed herein, and encoding a CFTR polypeptide, can be constructed using in vitro transcription. In other aspects, a polynucleotide (e.g., a RNA, e.g., an mRNA) disclosed herein, and encoding a CFTR polypeptide, can be constructed by chemical synthesis using an oligonucleotide synthesizer.

In other aspects, a polynucleotide (e.g., a RNA, e.g., an mRNA) disclosed herein, and encoding a CFTR polypeptide is made by using a host cell. In certain aspects, a polynucleotide (e.g., a RNA, e.g., an mRNA) disclosed herein, and encoding a CFTR polypeptide is made by one or more combination of the IVT, chemical synthesis, host cell expression, or any other methods known in the art.

Naturally occurring nucleosides, non-naturally occurring nucleosides, or combinations thereof, can totally or partially naturally replace occurring nucleosides present in the candidate nucleotide sequence and can be incorporated into a sequence-optimized nucleotide sequence (e.g., a RNA, e.g., an mRNA) encoding a CFTR polypeptide. The resultant polynucleotides, e.g., mRNAs, can then be examined for their ability to produce protein and/or produce a therapeutic outcome.

a. In Vitro Transcription/Enzymatic Synthesis

The polynucleotides of the present disclosure disclosed herein (e.g., a polynucleotide comprising a nucleotide sequence encoding a CFTR polypeptide) can be transcribed using an in vitro transcription (IVT) system. The system typically comprises a transcription buffer, nucleotide triphosphates (NTPs), an RNase inhibitor and a polymerase. The NTPs can be selected from, but are not limited to, those described herein including natural and unnatural (modified) NTPs. The polymerase can be selected from, but is not limited to, T7 RNA polymerase, T3 RNA polymerase and mutant polymerases such as, but not limited to, polymerases able to incorporate polynucleotides disclosed herein. See U.S. Publ. No. US20130259923, which is herein incorporated by reference in its entirety.

Any number of RNA polymerases or variants can be used in the synthesis of the polynucleotides of the present disclosure. RNA polymerases can be modified by inserting or deleting amino acids of the RNA polymerase sequence. As a non-limiting example, the RNA polymerase can be modified to exhibit an increased ability to incorporate a 2'-modified nucleotide triphosphate compared to an unmodified RNA polymerase (see International Publication WO2008078180 and U.S. Pat. No. 8,101,385; herein incorporated by reference in their entireties).

Variants can be obtained by evolving an RNA polymerase, optimizing the RNA polymerase amino acid and/or nucleic acid sequence and/or by using other methods known in the art. As a non-limiting example, T7 RNA polymerase variants can be evolved using the continuous directed evolution system set out by Esvelt et al. (Nature 472:499-503 (2011); herein incorporated by reference in its entirety) where clones of T7 RNA polymerase can encode at least one mutation such as, but not limited to, lysine at position 93 substituted for threonine (K93T), I4M, A7T, E63V, V64D, A65E, D66Y, T76N, C125R, S128R, A136T, N165S, G175R, H176L, Y178H, F182L, L196F, G198V, D208Y, E222K, S228A, Q239R, T243N, G259D, M267I, G280C, H300R, D351A, A354S, E356D, L360P, A383V, Y385C, D388Y, S397R, M401T, N410S, K450R, P451T, G452V, E484A, H523L, H$_{524}$N, G542V, E565K, K577E, K577M, N601S, S684Y, L699I, K713E, N748D, Q754R, E775K, A827V, D851N or L864F. As another non-limiting example, T7 RNA polymerase variants can encode at least mutation as described in U.S. Pub. Nos. 20100120024 and 20070117112; herein incorporated by reference in their entireties. Variants of RNA polymerase can also include, but are not limited to, substitutional variants, conservative amino acid substitution, insertional variants, deletional variants and/or covalent derivatives.

In one aspect, the polynucleotide can be designed to be recognized by the wild type or variant RNA polymerases. In doing so, the polynucleotide can be modified to contain sites or regions of sequence changes from the wild type or parent chimeric polynucleotide.

Polynucleotide or nucleic acid synthesis reactions can be carried out by enzymatic methods utilizing polymerases. Polymerases catalyze the creation of phosphodiester bonds between nucleotides in a polynucleotide or nucleic acid chain. Currently known DNA polymerases can be divided into different families based on amino acid sequence comparison and crystal structure analysis. DNA polymerase I (pol I) or A polymerase family, including the Klenow fragments of *E. coli, Bacillus* DNA polymerase I, *Therms aquaticus* (Taq) DNA polymerases, and the T7 RNA and DNA polymerases, is among the best studied of these families. Another large family is DNA polymerase a (pol a) or B polymerase family, including all eukaryotic replicating DNA polymerases and polymerases from phages T4 and RB69. Although they employ similar catalytic mechanism, these families of polymerases differ in substrate specificity, substrate analog-incorporating efficiency, degree and rate for primer extension, mode of DNA synthesis, exonuclease activity, and sensitivity against inhibitors.

DNA polymerases are also selected based on the optimum reaction conditions they require, such as reaction temperature, pH, and template and primer concentrations. Sometimes a combination of more than one DNA polymerases is employed to achieve the desired DNA fragment size and synthesis efficiency. For example, Cheng et al. increase pH, add glycerol and dimethyl sulfoxide, decrease denaturation times, increase extension times, and utilize a secondary thermostable DNA polymerase that possesses a 3' to 5' exonuclease activity to effectively amplify long targets from cloned inserts and human genomic DNA. (Cheng et al., PNAS 91:5695-5699 (1994), the contents of which are incorporated herein by reference in their entirety). RNA polymerases from bacteriophage T3, T7, and SP6 have been widely used to prepare RNAs for biochemical and biophysical studies. RNA polymerases, capping enzymes, and poly-A polymerases are disclosed in the co-pending International Publication No. WO2014028429, the contents of which are incorporated herein by reference in their entirety.

In one aspect, the RNA polymerase which can be used in the synthesis of the polynucleotides of the present disclosure is a Syn5 RNA polymerase. (see Zhu et al. Nucleic Acids Research 2013, doi:10.1093/nar/gkt1193, which is herein incorporated by reference in its entirety). The Syn5 RNA polymerase was recently characterized from marine cyanophage Syn5 by Zhu et al. where they also identified the promoter sequence (see Zhu et al. Nucleic Acids Research 2013, the contents of which is herein incorporated by reference in its entirety). Zhu et al. found that Syn5 RNA polymerase catalyzed RNA synthesis over a wider range of temperatures and salinity as compared to T7 RNA polymerase. Additionally, the requirement for the initiating nucleotide at the promoter was found to be less stringent for Syn5 RNA polymerase as compared to the T7 RNA polymerase making Syn5 RNA polymerase promising for RNA synthesis.

In one aspect, a Syn5 RNA polymerase can be used in the synthesis of the polynucleotides described herein. As a non-limiting example, a Syn5 RNA polymerase can be used in the synthesis of the polynucleotide requiring a precise 3'-terminus.

In one aspect, a Syn5 promoter can be used in the synthesis of the polynucleotides. As a non-limiting example, the Syn5 promoter can be 5'-ATTGGGCACCCGTAAGGG-3' (SEQ ID NO: 105 as described by Zhu et al. (Nucleic Acids Research 2013).

In one aspect, a Syn5 RNA polymerase can be used in the synthesis of polynucleotides comprising at least one chemical modification described herein and/or known in the art (see e.g., the incorporation of pseudo-UTP and 5Me-CTP described in Zhu et al. Nucleic Acids Research 2013).

In one aspect, the polynucleotides described herein can be synthesized using a Syn5 RNA polymerase which has been purified using modified and improved purification procedure described by Zhu et al. (Nucleic Acids Research 2013).

Various tools in genetic engineering are based on the enzymatic amplification of a target gene which acts as a template. For the study of sequences of individual genes or specific regions of interest and other research needs, it is necessary to generate multiple copies of a target gene from a small sample of polynucleotides or nucleic acids. Such methods can be applied in the manufacture of the polynucleotides of the present disclosure.

For example, polymerase chain reaction (PCR), strand displacement amplification (SDA), nucleic acid sequence-based amplification (NASBA), also called transcription mediated amplification (TMA), and rolling-circle amplification (RCA) can be utilized in the manufacture of one or more regions of the polynucleotides of the present disclosure.

Assembling polynucleotides or nucleic acids by a ligase is also widely used. DNA or RNA ligases promote intermolecular ligation of the 5' and 3' ends of polynucleotide chains through the formation of a phosphodiester bond.

b. Chemical Synthesis

Standard methods can be applied to synthesize an isolated polynucleotide sequence encoding an isolated polypeptide of interest, such as a polynucleotide of the present disclosure (e.g., a polynucleotide comprising a nucleotide sequence encoding a CFTR polypeptide). For example, a single DNA or RNA oligomer containing a codon-optimized nucleotide sequence coding for the particular isolated polypeptide can be synthesized. In other aspects, several small oligonucleotides coding for portions of the desired polypeptide can be synthesized and then ligated. In some aspects, the individual oligonucleotides typically contain 5' or 3' overhangs for complementary assembly.

A polynucleotide disclosed herein (e.g., a RNA, e.g., an mRNA) can be chemically synthesized using chemical synthesis methods and potential nucleobase substitutions known in the art. See, for example, International Publication Nos. WO2014093924, WO2013052523; WO2013039857, WO2012135805, WO2013151671; U.S. Publ. No. US20130115272; or U.S. Pat. Nos. 8,999,380 or 8,710,200, all of which are herein incorporated by reference in their entireties.

c. Purification of Polynucleotides Encoding CFTR

Purification of the polynucleotides described herein (e.g., a polynucleotide comprising a nucleotide sequence encoding a CFTR polypeptide) can include, but is not limited to, polynucleotide clean-up, quality assurance and quality control. Clean-up can be performed by methods known in the arts such as, but not limited to, AGENCOURT® beads (Beckman Coulter Genomics, Danvers, MA), poly-T beads, LNA™ oligo-T capture probes (EXIQON® Inc., Vedbaek, Denmark) or HPLC based purification methods such as, but not limited to, strong anion exchange HPLC, weak anion exchange HPLC, reverse phase HPLC (RP-HPLC), and hydrophobic interaction HPLC (HIC-HPLC).

The term "purified" when used in relation to a polynucleotide such as a "purified polynucleotide" refers to one that is separated from at least one contaminant. As used herein, a "contaminant" is any substance that makes another unfit, impure or inferior. Thus, a purified polynucleotide (e.g., DNA and RNA) is present in a form or setting different from that in which it is found in nature, or a form or setting different from that which existed prior to subjecting it to a treatment or purification method.

In some embodiments, purification of a polynucleotide of the present disclosure (e.g., a polynucleotide comprising a nucleotide sequence encoding a CFTR polypeptide) removes impurities that can reduce or remove an unwanted immune response, e.g., reducing cytokine activity.

In some embodiments, the polynucleotide of the present disclosure (e.g., a polynucleotide comprising a nucleotide sequence encoding a CFTR polypeptide) is purified prior to administration using column chromatography (e.g., strong anion exchange HPLC, weak anion exchange HPLC, reverse phase HPLC (RP-HPLC), and hydrophobic interaction HPLC (HIC-HPLC), or (LCMS)).

In some embodiments, the polynucleotide of the present disclosure (e.g., a polynucleotide comprising a nucleotide sequence a CFTR polypeptide) purified using column chromatography (e.g., strong anion exchange HPLC, weak anion exchange HPLC, reverse phase HPLC (RP-HPLC, hydrophobic interaction HPLC (HIC-HPLC), or (LCMS)) presents increased expression of the encoded CFTR protein compared to the expression level obtained with the same polynucleotide of the present disclosure purified by a different purification method.

In some embodiments, a column chromatography (e.g., strong anion exchange HPLC, weak anion exchange HPLC, reverse phase HPLC (RP-HPLC), hydrophobic interaction HPLC (HIC-HPLC), or (LCMS)) purified polynucleotide comprises a nucleotide sequence encoding a CFTR polypeptide comprising one or more of the point mutations known in the art.

In some embodiments, the use of RP-HPLC purified polynucleotide increases CFTR protein expression levels in cells when introduced into those cells, e.g., by 10-100%, i.e., at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 90%, at least about 95%, or at least about 100% with respect to the expression levels of CFTR protein in the cells before the RP-HPLC purified polynucleotide was introduced in the cells, or after a non-RP-HPLC purified polynucleotide was introduced in the cells.

In some embodiments, the use of RP-HPLC purified polynucleotide increases functional CFTR protein expression levels in cells when introduced into those cells, e.g., by 10-100%, i.e., at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 90%, at least about 95%, or at least about 100% with respect to the functional expression levels of CFTR protein in the cells before the RP-HPLC purified polynucleotide was introduced in the cells, or after a non-RP-HPLC purified polynucleotide was introduced in the cells.

In some embodiments, the use of RP-HPLC purified polynucleotide increases detectable CFTR activity in cells when introduced into those cells, e.g., by 10-100%, i.e., at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 90%, at least about 95%, or at least about 100% with respect to the activity levels of functional CFTR in the cells before the RP-HPLC purified polynucleotide was introduced in the cells, or after a non-RP-HPLC purified polynucleotide was introduced in the cells.

In some embodiments, the purified polynucleotide is at least about 80% pure, at least about 85% pure, at least about 90% pure, at least about 95% pure, at least about 96% pure, at least about 97% pure, at least about 98% pure, at least about 99% pure, or about 100% pure.

A quality assurance and/or quality control check can be conducted using methods such as, but not limited to, gel electrophoresis, UV absorbance, or analytical HPLC. In another embodiment, the polynucleotide can be sequenced by methods including, but not limited to reverse-transcriptase-PCR.

d. Quantification of Expressed Polynucleotides Encoding CFTR

In some embodiments, the polynucleotides of the present disclosure (e.g., a polynucleotide comprising a nucleotide sequence encoding a CFTR polypeptide), their expression products, as well as degradation products and metabolites can be quantified according to methods known in the art.

In some embodiments, the polynucleotides of the present disclosure can be quantified in exosomes or when derived from one or more bodily fluid. As used herein "bodily fluids" include peripheral blood, serum, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, and umbilical cord blood. Alternatively, exosomes can be retrieved from an organ selected from the group consisting of lung, heart, pancreas, stomach, intestine, bladder, kidney, ovary, testis, skin, colon, breast, prostate, brain, esophagus, liver, and placenta.

In the exosome quantification method, a sample of not more than 2 mL is obtained from the subject and the exosomes isolated by size exclusion chromatography, density gradient centrifugation, differential centrifugation, nanomembrane ultrafiltration, immunoabsorbent capture, affinity purification, microfluidic separation, or combinations thereof. In the analysis, the level or concentration of a polynucleotide can be an expression level, presence, absence, truncation or alteration of the administered construct. It is advantageous to correlate the level with one or more clinical phenotypes or with an assay for a human disease biomarker.

The assay can be performed using construct specific probes, cytometry, qRT-PCR, real-time PCR, PCR, flow cytometry, electrophoresis, mass spectrometry, or combinations thereof while the exosomes can be isolated using immunohistochemical methods such as enzyme linked immunosorbent assay (ELISA) methods. Exosomes can also be isolated by size exclusion chromatography, density gradient centrifugation, differential centrifugation, nanomembrane ultrafiltration, immunoabsorbent capture, affinity purification, microfluidic separation, or combinations thereof.

These methods afford the investigator the ability to monitor, in real time, the level of polynucleotides remaining or delivered. This is possible because the polynucleotides of the present disclosure differ from the endogenous forms due to the structural or chemical modifications.

In some embodiments, the polynucleotide can be quantified using methods such as, but not limited to, ultraviolet visible spectroscopy (UV/Vis). A non-limiting example of a UV/Vis spectrometer is a NANODROP® spectrometer (ThermoFisher, Waltham, MA). The quantified polynucleotide can be analyzed in order to determine if the polynucleotide can be of proper size, check that no degradation of the polynucleotide has occurred. Degradation of the polynucleotide can be checked by methods such as, but not limited to, agarose gel electrophoresis, HPLC based purification methods such as, but not limited to, strong anion exchange HPLC, weak anion exchange HPLC, reverse phase HPLC (RP-HPLC), and hydrophobic interaction HPLC (HIC-HPLC), liquid chromatography-mass spectrometry (LCMS), capillary electrophoresis (CE) and capillary gel electrophoresis (CGE).

21. Pharmaceutical Compositions and Formulations

The present disclosure provides pharmaceutical compositions and formulations that comprise any of the polynucleotides described above. In some embodiments, the composition or formulation further comprises a delivery agent.

In some embodiments, the composition or formulation can contain a polynucleotide comprising a sequence optimized nucleic acid sequence disclosed herein which encodes a CFTR polypeptide. In some embodiments, the composition or formulation can contain a polynucleotide (e.g., a RNA, e.g., an mRNA) comprising a polynucleotide (e.g., an ORF) having significant sequence identity to a sequence optimized nucleic acid sequence disclosed herein which encodes a CFTR polypeptide. In some embodiments, the polynucleotide further comprises a miRNA binding site, e.g., a miRNA binding site that binds miR-142 and/or miR-126.

Pharmaceutical compositions or formulation can optionally comprise one or more additional active substances, e.g., therapeutically and/or prophylactically active substances.

Pharmaceutical compositions or formulation of the present disclosure can be sterile and/or pyrogen-free. General considerations in the formulation and/or manufacture of pharmaceutical agents can be found, for example, in Remington: The Science and Practice of Pharmacy 21$^{st}$ ed., Lippincott Williams & Wilkins, 2005 (incorporated herein by reference in its entirety). In some embodiments, compositions are administered to humans, human patients or subjects. For the purposes of the present disclosure, the phrase "active ingredient" generally refers to polynucleotides to be delivered as described herein.

Formulations and pharmaceutical compositions described herein can be prepared by any method known or hereafter developed in the art of pharmacology. In general, such preparatory methods include the step of associating the active ingredient with an excipient and/or one or more other accessory ingredients, and then, if necessary and/or desirable, dividing, shaping and/or packaging the product into a desired single- or multi-dose unit.

A pharmaceutical composition or formulation in accordance with the present disclosure can be prepared, packaged, and/or sold in bulk, as a single unit dose, and/or as a plurality of single unit doses. As used herein, a "unit dose" refers to a discrete amount of the pharmaceutical composition comprising a predetermined amount of the active ingredient. The amount of the active ingredient is generally equal to the dosage of the active ingredient that would be administered to a subject and/or a convenient fraction of such a dosage such as, for example, one-half or one-third of such a dosage.

Relative amounts of the active ingredient, the pharmaceutically acceptable excipient, and/or any additional ingredients in a pharmaceutical composition in accordance with the present disclosure can vary, depending upon the identity, size, and/or condition of the subject being treated and further depending upon the route by which the composition is to be administered.

In some embodiments, the compositions and formulations described herein can contain at least one polynucleotide of the present disclosure. As a non-limiting example, the composition or formulation can contain 1, 2, 3, 4 or 5 polynucleotides of the present disclosure. In some embodiments, the compositions or formulations described herein can comprise more than one type of polynucleotide. In some embodiments, the composition or formulation can comprise a polynucleotide in linear and circular form. In another embodiment, the composition or formulation can comprise a circular polynucleotide and an IVT polynucleotide. In yet another embodiment, the composition or formulation can comprise an IVT polynucleotide, a chimeric polynucleotide and a circular polynucleotide.

Although the descriptions of pharmaceutical compositions and formulations provided herein are principally directed to pharmaceutical compositions and formulations that are suitable for administration to humans, it will be understood by the skilled artisan that such compositions are generally suitable for administration to any other animal, e.g., to non-human animals, e.g. non-human mammals.

The present disclosure provides pharmaceutical formulations that comprise a polynucleotide described herein (e.g., a polynucleotide comprising a nucleotide sequence encoding a CFTR polypeptide). The polynucleotides described herein can be formulated using one or more excipients to: (1) increase stability; (2) increase cell transfection; (3) permit the sustained or delayed release (e.g., from a depot formulation of the polynucleotide); (4) alter the biodistribution (e.g., target the polynucleotide to specific tissues or cell types); (5) increase the translation of encoded protein in vivo; and/or (6) alter the release profile of encoded protein in vivo. In some embodiments, the pharmaceutical formulation further comprises a delivery agent, (e.g., a compound having the Formula (I), (IA), (II), (IIa), (IIb), (IIc), (IId) or (IIe), e.g., any of Compounds 1-232).

A pharmaceutically acceptable excipient, as used herein, includes, but are not limited to, any and all solvents, dispersion media, or other liquid vehicles, dispersion or suspension aids, diluents, granulating and/or dispersing agents, surface active agents, isotonic agents, thickening or emulsifying agents, preservatives, binders, lubricants or oil, coloring, sweetening or flavoring agents, stabilizers, antioxidants, antimicrobial or antifungal agents, osmolality adjusting agents, pH adjusting agents, buffers, chelants, cyoprotectants, and/or bulking agents, as suited to the particular dosage form desired. Various excipients for formulating pharmaceutical compositions and techniques for preparing the composition are known in the art (see Remington: The Science and Practice of Pharmacy, 21st Edition, A. R. Gennaro (Lippincott, Williams & Wilkins, Baltimore, MD, 2006; incorporated herein by reference in its entirety).

Exemplary diluents include, but are not limited to, calcium or sodium carbonate, calcium phosphate, calcium hydrogen phosphate, sodium phosphate, lactose, sucrose, cellulose, microcrystalline cellulose, kaolin, mannitol, sorbitol, etc., and/or combinations thereof.

Exemplary granulating and/or dispersing agents include, but are not limited to, starches, pregelatinized starches, or microcrystalline starch, alginic acid, guar gum, agar, poly (vinyl-pyrrolidone), (providone), cross-linked poly(vinyl-pyrrolidone) (crospovidone), cellulose, methylcellulose, carboxymethyl cellulose, cross-linked sodium carboxymethyl cellulose (croscarmellose), magnesium aluminum silicate (VEEGUM®), sodium lauryl sulfate, etc., and/or combinations thereof.

Exemplary surface active agents and/or emulsifiers include, but are not limited to, natural emulsifiers (e.g., acacia, agar, alginic acid, sodium alginate, tragacanth, chondrux, cholesterol, xanthan, pectin, gelatin, egg yolk, casein, wool fat, cholesterol, wax, and lecithin), sorbitan fatty acid esters (e.g., polyoxyethylene sorbitan monooleate [TWEEN® 80], sorbitan monopalmitate [SPAN® 40], glyceryl monooleate, polyoxyethylene esters, polyethylene glycol fatty acid esters (e.g., CREMOPHOR®), polyoxyethylene ethers (e.g., polyoxyethylene lauryl ether [BRIJ® 30]), PLUORINC® F 68, POLOXAMER® 188, etc. and/or combinations thereof.

Exemplary binding agents include, but are not limited to, starch, gelatin, sugars (e.g., sucrose, glucose, dextrose, dextrin, molasses, lactose, lactitol, mannitol), amino acids (e.g., glycine), natural and synthetic gums (e.g., acacia, sodium alginate), ethylcellulose, hydroxyethylcellulose, hydroxypropyl methylcellulose, etc., and combinations thereof.

Oxidation is a potential degradation pathway for mRNA, especially for liquid mRNA formulations. In order to prevent oxidation, antioxidants can be added to the formulations. Exemplary antioxidants include, but are not limited to, alpha tocopherol, ascorbic acid, acorbyl palmitate, benzyl alcohol, butylated hydroxyanisole, m-cresol, methionine, butylated hydroxytoluene, monothioglycerol, sodium or potassium metabisulfite, propionic acid, propyl gallate, sodium ascorbate, etc., and combinations thereof.

Exemplary chelating agents include, but are not limited to, ethylenediaminetetraacetic acid (EDTA), citric acid monohydrate, disodium edetate, fumaric acid, malic acid, phosphoric acid, sodium edetate, tartaric acid, trisodium edetate, etc., and combinations thereof.

Exemplary antimicrobial or antifungal agents include, but are not limited to, benzalkonium chloride, benzethonium chloride, methyl paraben, ethyl paraben, propyl paraben, butyl paraben, benzoic acid, hydroxybenzoic acid, potassium or sodium benzoate, potassium or sodium sorbate, sodium propionate, sorbic acid, etc., and combinations thereof.

Exemplary preservatives include, but are not limited to, vitamin A, vitamin C, vitamin E, beta-carotene, citric acid, ascorbic acid, butylated hydroxyanisol, ethylenediamine, sodium lauryl sulfate (SLS), sodium lauryl ether sulfate (SLES), etc., and combinations thereof.

In some embodiments, the pH of polynucleotide solutions are maintained between pH 5 and pH 8 to improve stability. Exemplary buffers to control pH can include, but are not limited to sodium phosphate, sodium citrate, sodium succinate, histidine (or histidine-HCl), sodium malate, sodium carbonate, etc., and/or combinations thereof.

Exemplary lubricating agents include, but are not limited to, magnesium stearate, calcium stearate, stearic acid, silica, talc, malt, hydrogenated vegetable oils, polyethylene glycol, sodium benzoate, sodium or magnesium lauryl sulfate, etc., and combinations thereof.

The pharmaceutical composition or formulation described here can contain a cryoprotectant to stabilize a polynucleotide described herein during freezing. Exemplary cryoprotectants include, but are not limited to mannitol, sucrose, trehalose, lactose, glycerol, dextrose, etc., and combinations thereof.

The pharmaceutical composition or formulation described here can contain a bulking agent in lyophilized polynucleotide formulations to yield a "pharmaceutically elegant" cake, stabilize the lyophilized polynucleotides during long term (e.g., 36 month) storage. Exemplary bulking agents of the present disclosure can include, but are not limited to sucrose, trehalose, mannitol, glycine, lactose, raffinose, and combinations thereof.

In some embodiments, the pharmaceutical composition or formulation further comprises a delivery agent. The delivery agent of the present disclosure can include, without limitation, liposomes, lipid nanoparticles, lipidoids, polymers, lipoplexes, microvesicles, exosomes, peptides, proteins, cells transfected with polynucleotides, hyaluronidase, nanoparticle mimics, nanotubes, conjugates, and combinations thereof.

The formulations can be administered to the pulmonary tract. Aerosolized pharmaceutical formulations can be delivered to the lungs, preferably using a number of commercially available devices. Some of the available devices and formulations for delivery to pulmonary tissue are described in more detail below.

Formulations can be administered to the respiratory tract by suitable methods such as intranasal instillation, intratracheal instillation, and intratracheal injection. In some embodiments, the compositions are delivered into the lungs by inhalation of an aerosolized pharmaceutical formulation. Inhalation can occur through the nose and/or the mouth of the subject. Administration can occur by self-administration of the formulation while inhaling, or by administration of the formulation via a respirator to a subject on a respirator. Exemplary devices for delivering formulations to the lung include, but are not limited to, dry powder inhalers, pressurized metered dose inhalers, nebulizers, and electrohydrodynamic aerosol devices.

Liquid formulations can be administered to the lungs of a patient using a pressurized metered dose inhaler (pMDI). pMDIs generally include at least two components: a canister in which the liquid formulation is held under pressure in combination with one or more propellants, and a receptacle used to hold and actuate the canister. The canister may contain a single or multiple doses of the formulation. The canister may include a valve, typically a metering valve, from which the contents of the canister may be discharged. Aerosolized drug is dispensed from the pMDI by applying a force on the canister to push it into the receptacle, thereby opening the valve and causing the drug particles to be conveyed from the valve through the receptacle outlet. Upon discharge from the canister, the liquid formulation is atomized, forming an aerosol. pMDIs typically employ one or more propellants to pressurize the contents of the canister and to propel the liquid formulation out of the receptacle outlet, forming an aerosol. Any suitable propellants may be utilized. The propellant may take a variety of forms. For example, the propellant may be a compressed gas or a liquefied gas.

The liquid formulations can also be administered using a nebulizer. Nebulizers are liquid aerosol generators that convert the liquid formulation into mists or clouds of small droplets, preferably having diameters less than 5 microns mass median aerodynamic diameter, which can be inhaled into the lower respiratory tract. This process is called atomization. The droplets carry the one Or more active agents into the nose, upper airways or deep lungs when the aerosol cloud is inhaled. Any type of nebulizer may be used to administer the formulation to a patient, including, but not limited to pneumatic (jet) nebulizers and electromechanical nebulizers. Pneumatic (jet) nebulizers use a pressurized gas supply as a driving force for atomization of the liquid formulation. Compressed gas is delivered through a nozzle or jet to create a low pressure field which entrains a surrounding liquid formulation and shears it into a thin film or filaments. The film or filaments are unstable and break up into small droplets that are carried by the compressed gas flow into the inspiratory breath. Baffles inserted into the droplet plume screen out the larger droplets and return them to the bulk liquid reservoir. Electromechanical nebulizers use electrically generated mechanical force to atomize liquid formulations. The electromechanical driving force can be applied, for example, by vibrating the liquid formulation at ultrasonic frequencies, or by forcing the bulk liquid through small holes in a thin film. The forces generate thin liquid films or filament streams which break up into small droplets to form a slow moving aerosol stream which can be entrained in an inspiratory flow. Liquid formulations can also be administered using an electrohydrodynamic (EHD) aerosol device. EHD aerosol devices use electrical energy to aerosolize liquid drug solutions or suspensions.

Dry powder inhalers (DPIs) typically use a mechanism such as a burst of gas to create a cloud of dry powder inside a container, which can then be inhaled by the subject. In a DPI, the dose to be administered is stored in the form of a non-pressurized dry powder and, on actuation of the inhaler, the particles of the powder are inhaled by the subject. In some cases, a compressed gas (i.e., propellant) may be used to dispense the powder, similar to pressurized metered dose inhalers (pMDIs). In some cases, the DPI may be breath actuated, meaning that an aerosol is created in precise response to inspiration. Typically, dry powder inhalers administer a dose of less than a few tens of milligrams per inhalation to avoid provocation of cough. Examples of DPIs include the Turbohaler® inhaler (Astrazeneca, Wilmington, Del.), the Clickhaler® inhaler (Innovata, Ruddington, Nottingham, UKL), the Diskus® inhaler (Glaxo, Greenford, Middlesex, UK), the EasyHaler® (Orion, Expoo, FI), the Exubera® inhaler (Pfizer, New York, N.Y.), the Qdose® inhaler (Microdose, Monmouth Junction, N.J.), and the Spiros® inhaler (Dura, San Diego, CA).

The pharmaceutical compositions of the invention are administered in an effective amount to cause expression of a normal gene product to supplement or replace a defective CFTR, as measured by, in some embodiments, the alleviation of one or more symptom. The formulations may be administered in an effective amount to provide active or non-mutated CFTR in the apical membrane of respiratory and non-respiratory epithelial cells. In some embodiments, the pharmaceutical compositions are administered in an effective amount to induce absent CFTR activity in a patient suffering from CF or augment the existing level of residual CFTR activity in a patient suffering from CF.

The presence of residual CFTR activity at the epithelial surface can be readily detected using methods known in the art, including standard electrophysiological, biochemical, and/or histochemical techniques. Such methods identify and/or quantify CFTR activity using in vivo or ex vivo electrophysiological techniques, measurement of sweat or salivary CT concentrations, or ex vivo biochemical or histochemical techniques to monitor CFTR cell surface density.

22. Delivery Agents

The present disclosure provides pharmaceutical compositions with advantageous properties. For example, the lipids described herein (e.g. those having any of Formula (I), (IA), (II), (IIa), (IIb), (IIc), (IId), (IIe), (III), (IV), (V), or (VI) may be advantageously used in lipid nanoparticle compositions for the delivery of therapeutic and/or prophylactic agents to mammalian cells or organs. For example, the lipids described herein have little or no immunogenicity. For example, the lipid compounds disclosed hereinhave a lower immunogenicity as compared to a reference lipid (e.g., MC3, KC2, or DLinDMA). For example, a formulation comprising a lipid disclosed herein and a therapeutic or prophylactic agent has an increased therapeutic index as compared to a corresponding formulation which comprises a reference lipid (e.g., MC3, KC2, or DLinDMA) and the same therapeutic or prophylactic agent. In particular, the present application provides pharmaceutical compositions comprising:

(a) a polynucleotide comprising a nucleotide sequence encoding a CFTR polypeptide; and
(b) a lipid compound described herein.

Accelerated Blood Clearance (ABC)

The invention provides compounds, compositions and methods of use thereof for reducing the effect of ABC on a repeatedly administered active agent such as a biologically active agent. As will be readily apparent, reducing or eliminating altogether the effect of ABC on an administered active agent effectively increases its half-life and thus its efficacy.

In some embodiments the term reducing ABC refers to any reduction in ABC in comparison to a positive reference control ABC inducing LNP such as an MC3 LNP. ABC inducing LNPs cause a reduction in circulating levels of an active agent upon a second or subsequent administration within a given time frame. Thus a reduction in ABC refers to less clearance of circulating agent upon a second or subsequent dose of agent, relative to a standard LNP. The reduction may be, for instance, at least 10%, 15%, 20%, 25%, 30%, 35%, 40%, 45%, 50%, 55%, 60%, 65%, 70%, 75%, 80%, 85%, 90%, 95%, 98%, or 100%. In some embodiments the reduction is 10-100%, 10-50%, 20-100%, 20-50%, 30-100%, 30-50%, 40%-100%, 40-80%, 50-90%, or 50-100%. Alternatively the reduction in ABC may be characterized as at least a detectable level of circulating agent following a second or subsequent administration or at least a 2 fold, 3 fold, 4 fold, 5 fold increase in circulating agent relative to circulating agent following administration of a standard LNP. In some embodiments the reduction is a 2-100 fold, 2-50 fold, 3-100 fold, 3-50 fold, 3-20 fold, 4-100 fold, 4-50 fold, 4-40 fold, 4-30 fold, 4-25 fold, 4-20 fold, 4-15 fold, 4-10 fold, 4-5 fold, 5-100 fold, 5-50 fold, 5-40 fold, 5-30 fold, 5-25 fold, 5-20 fold, 5-15 fold, 5-10 fold, 6-100 fold, 6-50 fold, 6-40 fold, 6-30 fold, 6-25 fold, 6-20 fold, 6-15 fold, 6-10 fold, 8-100 fold, 8-50 fold, 8-40 fold, 8-30 fold, 8-25 fold, 8-20 fold, 8-15 fold, 8-10 fold, 10-100 fold, 10-50 fold, 10-40 fold, 10-30 fold, 10-25 fold, 10-20 fold, 10-15 fold, 20-100 fold, 20-50 fold, 20-40 fold, 20-30 fold, or 20-25 fold.

The disclosure provides lipid-comprising compounds and compositions that are less susceptible to clearance and thus have a longer half-life in vivo. This is particularly the case where the compositions are intended for repeated including chronic administration, and even more particularly where such repeated administration occurs within days or weeks.

Significantly, these compositions are less susceptible or altogether circumvent the observed phenomenon of accelerated blood clearance (ABC). ABC is a phenomenon in which certain exogenously administered agents are rapidly cleared from the blood upon second and subsequent administrations. This phenomenon has been observed, in part, for a variety of lipid-containing compositions including but not limited to lipidated agents, liposomes or other lipid-based delivery vehicles, and lipid-encapsulated agents. Heretofore, the basis of ABC has been poorly understood and in some cases attributed to a humoral immune response and accordingly strategies for limiting its impact in vivo particularly in a clinical setting have remained elusive.

This disclosure provides compounds and compositions that are less susceptible, if at all susceptible, to ABC. In some important aspects, such compounds and compositions are lipid-comprising compounds or compositions. The lipid-containing compounds or compositions of this disclosure, surprisingly, do not experience ABC upon second and subsequent administration in vivo. This resistance to ABC renders these compounds and compositions particularly suitable for repeated use in vivo, including for repeated use within short periods of time, including days or 1-2 weeks. This enhanced stability and/or half-life is due, in part, to the inability of these compositions to activate B1a and/or B1b cells and/or conventional B cells, pDCs and/or platelets.

This disclosure therefore provides an elucidation of the mechanism underlying accelerated blood clearance (ABC). It has been found, in accordance with this disclosure and the inventions provided herein, that the ABC phenomenon at least as it relates to lipids and lipid nanoparticles is mediated, at least in part an innate immune response involving B1a and/or B1b cells, pDC and/or platelets. B1a cells are normally responsible for secreting natural antibody, in the form of circulating IgM. This IgM is poly-reactive, meaning that it is able to bind to a variety of antigens, albeit with a relatively low affinity for each.

It has been found in accordance with the invention that some lipidated agents or lipid-comprising formulations such as lipid nanoparticles administered in vivo trigger and are subject to ABC. It has now been found in accordance with the invention that upon administration of a first dose of the LNP, one or more cells involved in generating an innate immune response (referred to herein as sensors) bind such agent, are activated, and then initiate a cascade of immune factors (referred to herein as effectors) that promote ABC and toxicity. For instance, B1a and B1b cells may bind to LNP, become activated (alone or in the presence of other sensors such as pDC and/or effectors such as IL6) and secrete natural IgM that binds to the LNP. Pre-existing natural IgM in the subject may also recognize and bind to the LNP, thereby triggering complement fixation. After administration of the first dose, the production of natural IgM begins within 1-2 hours of administration of the LNP. Typically by about 2-3 weeks the natural IgM is cleared from the system due to the natural half-life of IgM. Natural IgG is produced beginning around 96 hours after administration of the LNP. The agent, when administered in a naïve setting, can exert its biological effects relatively unencumbered by the natural IgM produced post-activation of the B1a cells or B1b cells or natural IgG. The natural IgM and natural IgG are non-specific and thus are distinct from anti-PEG IgM and anti-PEG IgG.

Although Applicant is not bound by mechanism, it is proposed that LNPs trigger ABC and/or toxicity through the following mechanisms. It is believed that when an LNP is administered to a subject the LNP is rapidly transported through the blood to the spleen. The LNPs may encounter immune cells in the blood and/or the spleen. A rapid innate immune response is triggered in response to the presence of the LNP within the blood and/or spleen. Applicant has shown herein that within hours of administration of an LNP several immune sensors have reacted to the presence of the LNP. These sensors include but are not limited to immune cells involved in generating an immune response, such as B cells, pDC, and platelets. The sensors may be present in the spleen, such as in the marginal zone of the spleen and/or in the blood. The LNP may physically interact with one or more sensors, which may interact with other sensors. In such a case the LNP is directly or indirectly interacting with the sensors. The sensors may interact directly with one another in response to recognition of the LNP. For instance many sensors are located in the spleen and can easily interact with one another. Alternatively one or more of the sensors may interact with LNP in the blood and become activated. The activated sensor may then interact directly with other sensors or indirectly (e.g., through the stimulation or production of a messenger such as a cytokine e.g., IL6).

In some embodiments the LNP may interact directly with and activate each of the following sensors: pDC, B1a cells, B1b cells, and platelets. These cells may then interact directly or indirectly with one another to initiate the production of effectors which ultimately lead to the ABC and/or toxicity associated with repeated doses of LNP. For instance, Applicant has shown that LNP administration leads to pDC activation, platelet aggregation and activation and B cell activation. In response to LNP platelets also aggregate and are activated and aggregate with B cells. pDC cells are activated. LNP has been found to interact with the surface of platelets and B cells relatively quickly. Blocking the activation of any one or combination of these sensors in response to LNP is useful for dampening the immune response that would ordinarily occur. This dampening of the immune response results in the avoidance of ABC and/or toxicity.

The sensors once activated produce effectors. An effector, as used herein, is an immune molecule produced by an immune cell, such as a B cell. Effectors include but are not limited to immunoglobulin such as natural IgM and natural IgG and cytokines such as IL6. B1a and B1b cells stimulate the production of natural IgMs within 2-6 hours following administration of an LNP. Natural IgG can be detected within 96 hours. IL6 levels are increased within several hours. The natural IgM and IgG circulate in the body for several days to several weeks. During this time the circulating effectors can interact with newly administered LNPs, triggering those LNPs for clearance by the body. For instance, an effector may recognize and bind to an LNP. The Fc region of the effector may be recognized by and trigger uptake of the decorated LNP by macrophage. The macrophage are then transported to the spleen. The production of effectors by immune sensors is a transient response that correlates with the timing observed for ABC.

If the administered dose is the second or subsequent administered dose, and if such second or subsequent dose is administered before the previously induced natural IgM and/or IgG is cleared from the system (e.g., before the 2-3 window time period), then such second or subsequent dose is targeted by the circulating natural IgM and/or natural IgG or Fc which trigger alternative complement pathway activation and is itself rapidly cleared. When LNP are administered after the effectors have cleared from the body or are reduced in number, ABC is not observed.

Thus, it is useful according to aspects of the invention to inhibit the interaction between LNP and one or more sensors, to inhibit the activation of one or more sensors by LNP (direct or indirect), to inhibit the production of one or more effectors, and/or to inhibit the activity of one or more effectors. In some embodiments the LNP is designed to limit or block interaction of the LNP with a sensor. For instance the LNP may have an altered PC and/or PEG to prevent interactions with sensors. Alternatively or additionally an agent that inhibits immune responses induced by LNPs may be used to achieve any one or more of these effects.

It has also been determined that conventional B cells are also implicated in ABC. Specifically, upon first administration of an agent, conventional B cells, referred to herein as CD19(+), bind to and react against the agent. Unlike B1a and B1b cells though, conventional B cells are able to mount first an IgM response (beginning around 96 hours after administration of the LNPs) followed by an IgG response (beginning around 14 days after administration of the LNPs) concomitant with a memory response. Thus conventional B cells react against the administered agent and contribute to IgM (and eventually IgG) that mediates ABC. The IgM and IgG are typically anti-PEG IgM and anti-PEG IgG.

It is contemplated that in some instances, the majority of the ABC response is mediated through B1a cells and B1a-mediated immune responses. It is further contemplated that in some instances, the ABC response is mediated by both IgM and IgG, with both conventional B cells and B1a cells mediating such effects. In yet still other instances, the ABC response is mediated by natural IgM molecules, some of which are capable of binding to natural IgM, which may be produced by activated B1a cells. The natural IgMs may bind to one or more components of the LNPs, e.g., binding to a phospholipid component of the LNPs (such as binding to the PC moiety of the phospholipid) and/or binding to a PEG-lipid component of the LNPs (such as binding to PEG-DMG, in particular, binding to the PEG moiety of PEG-DMG). Since B1a expresses CD36, to which phosphatidylcholine is a ligand, it is contemplated that the CD36 receptor may mediate the activation of B1a cells and thus production of natural IgM. In yet still other instances, the ABC response is mediated primarily by conventional B cells.

It has been found in accordance with the invention that the ABC phenomenon can be reduced or abrogated, at least in part, through the use of compounds and compositions (such as agents, delivery vehicles, and formulations) that do not activate B1a cells. Compounds and compositions that do not activate B1a cells may be referred to herein as B1a inert compounds and compositions. It has been further found in accordance with the invention that the ABC phenomenon can be reduced or abrogated, at least in part, through the use of compounds and compositions that do not activate conventional B cells. Compounds and compositions that do not activate conventional B cells may in some embodiments be referred to herein as CD19-inert compounds and compositions. Thus, in some embodiments provided herein, the compounds and compositions do not activate B1a cells and they do not activate conventional B cells. Compounds and compositions that do not activate B1a cells and conventional B cells may in some embodiments be referred to herein as B1a/CD19-inert compounds and compositions.

These underlying mechanisms were not heretofore understood, and the role of B1a and B1b cells and their interplay with conventional B cells in this phenomenon was also not appreciated.

Accordingly, this disclosure provides compounds and compositions that do not promote ABC. These may be further characterized as not capable of activating B1a and/or B1b cells, platelets and/or pDC, and optionally conventional B cells also. These compounds (e.g., agents, including biologically active agents such as prophylactic agents, therapeutic agents and diagnostic agents, delivery vehicles, including liposomes, lipid nanoparticles, and other lipid-based encapsulating structures, etc.) and compositions (e.g., formulations, etc.) are particularly desirable for applications requiring repeated administration, and in particular repeated administrations that occur within with short periods of time (e.g., within 1-2 weeks). This is the case, for example, if the agent is a nucleic acid based therapeutic that is provided to a subject at regular, closely-spaced intervals. The findings provided herein may be applied to these and other agents that are similarly administered and/or that are subject to ABC.

Of particular interest are lipid-comprising compounds, lipid-comprising particles, and lipid-comprising compositions as these are known to be susceptible to ABC. Such lipid-comprising compounds particles, and compositions have been used extensively as biologically active agents or as delivery vehicles for such agents. Thus, the ability to improve their efficacy of such agents, whether by reducing the effect of ABC on the agent itself or on its delivery vehicle, is beneficial for a wide variety of active agents.

Also provided herein are compositions that do not stimulate or boost an acute phase response (ARP) associated with repeat dose administration of one or more biologically active agents.

The composition, in some instances, may not bind to IgM, including but not limited to natural IgM.

The composition, in some instances, may not bind to an acute phase protein such as but not limited to C-reactive protein.

The composition, in some instances, may not trigger a CD5(+) mediated immune response. As used herein, a CD5(+) mediated immune response is an immune response that is mediated by B1a and/or B1b cells. Such a response may include an ABC response, an acute phase response, induction of natural IgM and/or IgG, and the like.

The composition, in some instances, may not trigger a CD19(+) mediated immune response. As used herein, a CD19(+) mediated immune response is an immune response that is mediated by conventional CD19(+), CD5(−) B cells. Such a response may include induction of IgM, induction of IgG, induction of memory B cells, an ABC response, an anti-drug antibody (ADA) response including an anti-protein response where the protein may be encapsulated within an LNP, and the like.

B1a cells are a subset of B cells involved in innate immunity. These cells are the source of circulating IgM, referred to as natural antibody or natural serum antibody. Natural IgM antibodies are characterized as having weak affinity for a number of antigens, and therefore they are referred to as "poly-specific" or "poly-reactive", indicating their ability to bind to more than one antigen. B1a cells are not able to produce IgG. Additionally, they do not develop into memory cells and thus do not contribute to an adaptive immune response. However, they are able to secrete IgM upon activation. The secreted IgM is typically cleared within about 2-3 weeks, at which point the immune system is rendered relatively naïve to the previously administered antigen. If the same antigen is presented after this time period (e.g., at about 3 weeks after the initial exposure), the antigen is not rapidly cleared. However, significantly, if the antigen is presented within that time period (e.g., within 2 weeks, including within 1 week, or within days), then the antigen is rapidly cleared. This delay between consecutive doses has rendered certain lipid-containing therapeutic or diagnostic agents unsuitable for use.

In humans, B1a cells are CD19(+), CD20(+), CD27(+), CD43(+), CD70(−) and CD5(+). In mice, B1a cells are CD19(+), CD5(+), and CD45 B cell isoform B220(+). It is the expression of CD5 which typically distinguishes B1a cells from other convention B cells. B1a cells may express high levels of CD5, and on this basis may be distinguished from other B-1 cells such as B-1b cells which express low or undetectable levels of CD5. CD5 is a pan-T cell surface glycoprotein. B1a cells also express CD36, also known as fatty acid translocase. CD36 is a member of the class B scavenger receptor family. CD36 can bind many ligands, including oxidized low density lipoproteins, native lipoproteins, oxidized phospholipids, and long-chain fatty acids.

B1b cells are another subset of B cells involved in innate immunity. These cells are another source of circulating natural IgM. Several antigens, including PS, are capable of inducing T cell independent immunity through B1b activation. CD27 is typically upregulated on B1b cells in response to antigen activation. Similar to B1a cells, the B1b cells are typically located in specific body locations such as the spleen and peritoneal cavity and are in very low abundance in the blood. The B1b secreted natural IgM is typically cleared within about 2-3 weeks, at which point the immune system is rendered relatively naïve to the previously administered antigen. If the same antigen is presented after this time period (e.g., at about 3 weeks after the initial exposure), the antigen is not rapidly cleared. However, significantly, if the antigen is presented within that time period (e.g., within 2 weeks, including within 1 week, or within days), then the antigen is rapidly cleared. This delay between consecutive doses has rendered certain lipid-containing therapeutic or diagnostic agents unsuitable for use.

In some embodiments it is desirable to block B1a and/or B1b cell activation. One strategy for blocking B1a and/or B1b cell activation involves determining which components of a lipid nanoparticle promote B cell activation and neutralizing those components. It has been discovered herein that at least PEG and phosphatidylcholine (PC) contribute to B1a and B1b cell interaction with other cells and/or activation. PEG may play a role in promoting aggregation between B1 cells and platelets, which may lead to activation. PC (a helper lipid in LNPs) is also involved in activating the B1 cells, likely through interaction with the CD36 receptor on the B cell surface. Numerous particles have PEG-lipid alternatives, PEG-less, and/or PC replacement lipids (e.g. oleic acid or analogs thereof) have been designed and tested. Applicant has established that replacement of one or more of these components within an LNP that otherwise would promote ABC upon repeat administration, is useful in preventing ABC by reducing the production of natural IgM and/or B cell activation. Thus, the invention encompasses LNPs that have reduced ABC as a result of a design which eliminates the inclusion of B cell triggers.

Another strategy for blocking B1a and/or B1b cell activation involves using an agent that inhibits immune responses induced by LNPs. These types of agents are discussed in more detail below. In some embodiments these agents block the interaction between B1a/B1b cells and the LNP or platelets or pDC. For instance the agent may be an antibody or other binding agent that physically blocks the interaction. An example of this is an antibody that binds to CD36 or CD6. The agent may also be a compound that prevents or disables the B1a/B1b cell from signaling once activated or prior to activation. For instance, it is possible to block one or more components in the B1a/B1b signaling cascade the results from B cell interaction with LNP or other immune cells. In other embodiments the agent may act one or more effectors produced by the B1a/B1b cells following activation. These effectors include for instance, natural IgM and cytokines.

It has been demonstrated according to aspects of the invention that when activation of pDC cells is blocked, B cell activation in response to LNP is decreased. Thus, in order to avoid ABC and/or toxicity, it may be desirable to prevent pDC activation. Similar to the strategies discussed above, pDC cell activation may be blocked by agents that interfere with the interaction between pDC and LNP and/or B cells/platelets. Alternatively agents that act on the pDC to block its ability to get activated or on its effectors can be used together with the LNP to avoid ABC.

Platelets may also play an important role in ABC and toxicity. Very quickly after a first dose of LNP is administered to a subject platelets associate with the LNP, aggregate and are activated. In some embodiments it is desirable to block platelet aggregation and/or activation. One strategy for blocking platelet aggregation and/or activation involves determining which components of a lipid nanoparticle promote platelet aggregation and/or activation and neutralizing those components. It has been discovered herein that at least PEG contribute to platelet aggregation, activation and/or interaction with other cells. Numerous particles have PEG-lipid alternatives and PEG-less have been designed and tested. Applicant has established that replacement of one or more of these components within an LNP that otherwise would promote ABC upon repeat administration, is useful in preventing ABC by reducing the production of natural IgM and/or platelet aggregation. Thus, the invention encompasses LNPs that have reduced ABC as a result of a design which eliminates the inclusion of platelet triggers. Alternatively agents that act on the platelets to block its activity once it is activated or on its effectors can be used together with the LNP to avoid ABC.

Measuring ABC Activity and Related Activities

Various compounds and compositions provided herein, including LNPs, do not promote ABC activity upon administration in vivo. These LNPs may be characterized and/or identified through any of a number of assays, such as but not limited to those described below, as well as any of the assays disclosed in the Examples section, include the methods subsection of the Examples.

In some embodiments the methods involve administering an LNP without producing an immune response that promotes ABC. An immune response that promotes ABC involves activation of one or more sensors, such as B1 cells, pDC, or platelets, and one or more effectors, such as natural IgM, natural IgG or cytokines such as IL6. Thus administration of an LNP without producing an immune response that promotes ABC, at a minimum involves administration of an LNP without significant activation of one or more sensors and significant production of one or more effectors. Significant used in this context refers to an amount that would lead to the physiological consequence of accelerated blood clearance of all or part of a second dose with respect to the level of blood clearance expected for a second dose of an ABC triggering LNP. For instance, the immune response should be dampened such that the ABC observed after the second dose is lower than would have been expected for an ABC triggering LNP.

B1a or B1b Activation Assay

Certain compositions provided in this disclosure do not activate B cells, such as B1a or B1b cells (CD19+ CD5+) and/or conventional B cells (CD19+ CD5−). Activation of B1a cells, B1b cells, or conventional B cells may be determined in a number of ways, some of which are provided below. B cell population may be provided as fractionated B cell populations or unfractionated populations of splenocytes or peripheral blood mononuclear cells (PBMC). If the latter, the cell population may be incubated with the LNP of choice for a period of time, and then harvested for further analysis. Alternatively, the supernatant may be harvested and analyzed.

Upregulation of Activation Marker Cell Surface Expression

Activation of B1a cells, B1b cells, or conventional B cells may be demonstrated as increased expression of B cell activation markers including late activation markers such as CD86. In an exemplary non-limiting assay, unfractionated B cells are provided as a splenocyte population or as a PBMC population, incubated with an LNP of choice for a particular period of time, and then stained for a standard B cell marker such as CD19 and for an activation marker such as CD86, and analyzed using for example flow cytometry. A suitable negative control involves incubating the same population with medium, and then performing the same staining and visualization steps. An increase in CD86 expression in the test population compared to the negative control indicates B cell activation.

Pro-Inflammatory Cytokine Release

B cell activation may also be assessed by cytokine release assay. For example, activation may be assessed through the production and/or secretion of cytokines such as IL-6 and/or TNF-alpha upon exposure with LNPs of interest.

Such assays may be performed using routine cytokine secretion assays well known in the art. An increase in cytokine secretion is indicative of B cell activation.

LNP Binding/Association to and/or Uptake by B Cells

LNP association or binding to B cells may also be used to assess an LNP of interest and to further characterize such LNP. Association/binding and/or uptake/internalization may be assessed using a detectably labeled, such as fluorescently labeled, LNP and tracking the location of such LNP in or on B cells following various periods of incubation.

The invention further contemplates that the compositions provided herein may be capable of evading recognition or detection and optionally binding by downstream mediators of ABC such as circulating IgM and/or acute phase response mediators such as acute phase proteins (e.g., C-reactive protein (CRP).

Methods of Use for Reducing ABC

Also provided herein are methods for delivering LNPs, which may encapsulate an agent such as a therapeutic agent, to a subject without promoting ABC.

In some embodiments, the method comprises administering any of the LNPs described herein, which do not promote ABC, for example, do not induce production of natural IgM binding to the LNPs, do not activate B1a and/or B1b cells. As used herein, an LNP that "does not promote ABC" refers to an LNP that induces no immune responses that would lead to substantial ABC or a substantially low level of immune responses that is not sufficient to lead to substantial ABC. An LNP that does not induce the production of natural IgMs binding to the LNP refers to LNPs that induce either no natural IgM binding to the LNPs or a substantially low level of the natural IgM molecules, which is insufficient to lead to substantial ABC. An LNP that does not activate B1a and/or B1b cells refer to LNPs that induce no response of B1a and/or B1b cells to produce natural IgM binding to the LNPs or a substantially low level of B1a and/or B1b responses, which is insufficient to lead to substantial ABC.

In some embodiments the terms do not activate and do not induce production are a relative reduction to a reference value or condition. In some embodiments the reference value or condition is the amount of activation or induction of production of a molecule such as IgM by a standard LNP such as an MC3 LNP. In some embodiments the relative reduction is a reduction of at least 30%, for example at least 30%, 35%, 40%, 45%, 50%, 55%, 60%, 65%, 70%, 75%, 80%, 85%, 90%, 91%, 92%, 93%, 94%, 95%, 96%, 97%, 98%, 99%, or 100%. In other embodiments the terms do not activate cells such as B cells and do not induce production of a protein such as IgM may refer to an undetectable amount of the active cells or the specific protein.

Platelet Effects and Toxicity

The invention is further premised in part on the elucidation of the mechanism underlying dose-limiting toxicity associated with LNP administration. Such toxicity may involve coagulopathy, disseminated intravascular coagulation (DIC, also referred to as consumptive coagulopathy), whether acute or chronic, and/or vascular thrombosis. In some instances, the dose-limiting toxicity associated with LNPs is acute phase response (APR) or complement activation-related psudoallergy (CARPA).

As used herein, coagulopathy refers to increased coagulation (blood clotting) in vivo. The findings reported in this disclosure are consistent with such increased coagulation and significantly provide insight on the underlying mechanism. Coagulation is a process that involves a number of different factors and cell types, and heretofore the relationship between and interaction of LNPs and platelets has not been understood in this regard. This disclosure provides evidence of such interaction and also provides compounds and compositions that are modified to have reduced platelet effect, including reduced platelet association, reduced platelet aggregation, and/or reduced platelet aggregation. The ability to modulate, including preferably down-modulate, such platelet effects can reduce the incidence and/or severity of coagulopathy post-LNP administration. This in turn will reduce toxicity relating to such LNP, thereby allowing higher doses of LNPs and importantly their cargo to be administered to patients in need thereof.

CARPA is a class of acute immune toxicity manifested in hypersensitivity reactions (HSRs), which may be triggered by nanomedicines and biologicals. Unlike allergic reactions, CARPA typically does not involve IgE but arises as a consequence of activation of the complement system, which is part of the innate immune system that enhances the body's abilities to clear pathogens. One or more of the following pathways, the classical complement pathway (CP), the alternative pathway (AP), and the lectin pathway (LP), may be involved in CARPA. Szebeni, Molecular Immunology, 61:163-173 (2014).

The classical pathway is triggered by activation of the C1-complex, which contains. C1q, C1r, C1s, or C1qr2s2. Activation of the C1-complex occurs when C1q binds to IgM or IgG complexed with antigens, or when C1q binds directly to the surface of the pathogen. Such binding leads to conformational changes in the C1q molecule, which leads to the activation of C1r, which in turn, cleave C1s. The C1r2s2 component now splits C4 and then C2, producing C4a, C4b, C2a, and C2b. C4b and C2b bind to form the classical pathway C3-convertase (C4b2b complex), which promotes cleavage of C3 into C3a and C3b. C3b then binds the C3 convertase to from the C5 convertase (C4b2b3b complex). The alternative pathway is continuously activated as a result of spontaneous C3 hydrolysis. Factor P (properdin) is a positive regulator of the alternative pathway. Oligomerization of properdin stabilizes the C3 convertase, which can then cleave much more C3. The C3 molecules can bind to surfaces and recruit more B, D, and P activity, leading to amplification of the complement activation.

Acute phase response (APR) is a complex systemic innate immune responses for preventing infection and clearing potential pathogens. Numerous proteins are involved in APR and C-reactive protein is a well-characterized one.

It has been found, in accordance with the invention, that certain LNP are able to associate physically with platelets almost immediately after administration in vivo, while other LNP do not associate with platelets at all or only at background levels. Significantly, those LNPs that associate with platelets also apparently stabilize the platelet aggregates that are formed thereafter. Physical contact of the platelets with certain LNPs correlates with the ability of such platelets to remain aggregated or to form aggregates continuously for an extended period of time after administration. Such aggregates comprise activated platelets and also innate immune cells such as macrophages and B cells.

1. LNP

In one set of embodiments, lipid nanoparticles (LNPs) are provided. In one embodiment, a lipid nanoparticle comprises lipids including an ionizable lipid, a structural lipid, a phospholipid, and mRNA. Each of the LNPs described herein may be used as a formulation for the mRNA described herein. In one embodiment, a lipid nanoparticle comprises an ionizable lipid, a structural lipid, a phospholipid, and mRNA. In some embodiments, the LNP comprises an ionizable lipid, a PEG-modified lipid, a sterol and a structural lipid. In some embodiments, the LNP has a molar ratio of about 20-60% ionizable lipid: about 5-25% structural lipid: about 25-55% sterol; and about 0.5-15% PEG-modified lipid. In some embodiments, the LNP comprises a molar ratio of about 50% ionizable lipid, about 1.5% PEG-modified lipid, about 38.5% cholesterol and about 10% structural lipid. In some embodiments, the LNP comprises a molar ratio of about 55% ionizable lipid, about 2.5% PEG lipid, about 32.5% cholesterol and about 10% structural lipid. In some embodiments, the ionizable lipid is an ionizable amino lipid, sometimes referred to in the prior art as an "ionizable cationic lipid" and the structural lipid is a neutral lipid, and the sterol is a cholesterol. In some embodiments, the LNP has a molar ratio of 50:38.5:10:1.5 of ionizable lipid: cholesterol: PEG2000-DMG:DSPC.

In some embodiments, the LNP has a polydispersity value of less than 0.4. In some embodiments, the LNP has a net neutral charge at a neutral pH. In some embodiments, the LNP has a mean diameter of 50-150 nm. In some embodiments, the LNP has a mean diameter of 80-100 nm.

As generally defined herein, the term "lipid" refers to a small molecule that has hydrophobic or amphiphilic properties. Lipids may be naturally occurring or synthetic. Examples of classes of lipids include, but are not limited to, fats, waxes, sterol-containing metabolites, vitamins, fatty acids, glycerolipids, glycerophospholipids, sphingolipids, saccharolipids, and polyketides, and prenol lipids. In some instances, the amphiphilic properties of some lipids leads them to form liposomes, vesicles, or membranes in aqueous media.

In some embodiments, a lipid nanoparticle (LNP) may comprise an ionizable lipid. As used herein, the term "ionizable lipid" has its ordinary meaning in the art and may refer to a lipid comprising one or more charged moieties. In some embodiments, an ionizable lipid may be positively charged or negatively charged. For instance, an ionizable lipid may be positively charged at lower pHs, in which case it could be referred to as "cationic lipid." In certain embodiments, an ionizable lipid molecule may comprise an amine group, and can be referred to as an ionizable amino lipids. As used herein, a "charged moiety" is a chemical moiety that carries a formal electronic charge, e.g., monovalent (+1, or −1), divalent (+2, or −2), trivalent (+3, or −3), etc. The charged moiety may be anionic (i.e., negatively charged) or cationic (i.e., positively charged). Examples of positively-charged moieties include amine groups (e.g., primary, secondary, and/or tertiary amines), ammonium groups, pyridinium group, guanidine groups, and imidizolium groups. In a particular embodiment, the charged moieties comprise amine groups. Examples of negatively-charged groups or precursors thereof, include carboxylate groups, sulfonate groups, sulfate groups, phosphonate groups, phosphate groups, hydroxyl groups, and the like. The charge of the charged moiety may vary, in some cases, with the environmental conditions, for example, changes in pH may alter the charge of the moiety, and/or cause the moiety to become charged or uncharged. In general, the charge density of the molecule may be selected as desired.

It should be understood that the terms "charged" or "charged moiety" does not refer to a "partial negative charge" or "partial positive charge" on a molecule. The terms "partial negative charge" and "partial positive charge" are given its ordinary meaning in the art. A "partial negative charge" may result when a functional group comprises a bond that becomes polarized such that electron density is pulled toward one atom of the bond, creating a partial negative charge on the atom. Those of ordinary skill in the art will, in general, recognize bonds that can become polarized in this way.

In some embodiments, the ionizable lipid is an ionizable amino lipid. In one embodiment, the ionizable amino lipid may have a positively charged hydrophilic head and a hydrophobic tail that are connected via a linker structure.

A lipid nanoparticle composition of the invention may include one or more ionizable (e.g., ionizable amino) lipids (e.g., lipids that may have a positive or partial positive charge at physiological pH). Ionizable lipids may be selected from the non-limiting group consisting of 3-(didodecylamino)-N1,N1,4-tridodecyl-1-piperazineethanamine (KL10), N1-[2-(didodecylamino)ethyl]N1,N4,N4-tridodecyl-1,4-piperazinediethanamine (KL22), 14,25-ditridecyl-15,18,21,24-tetraaza-octatriacontane (KL25), 1,2-dilinoleyloxy-N,N-dimethylaminopropane (DLin-DMA), 2,2-dilinoleyl-4-dimethylaminomethyl-[1,3]-dioxolane (DLin-K-DMA), heptatriaconta-6,9,28,31-tetraen-19-yl-4-(dimethylamino)butanoate (DLin-MC3-DMA), 2,2-dilinoleyl-4-(2 dimethylaminoethyl)-[1,3]-dioxolane (DLin-KC2-DMA), 1,2-dioleyloxy-N,N-dimethylaminopropane (DODMA), 2-({8[(3β)-cholest-5-en-3-yloxy]octyl}oxy) N,N dimethyl-3-[(9Z,12Z)-octadeca-9,12-dien-1-yloxy]propan-1-amine (Octyl-CLinDMA), (2R)-2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA (2R)), and (2S) 2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA (2S)). In addition to these, an ionizable lipid may also be a lipid including a cyclic amine group.

Ionizable lipids can also be the compounds disclosed in International Publication No. WO 2017/075531 A1, hereby incorporated by reference in its entirety. For example, the ionizable amino lipids include, but not limited to:

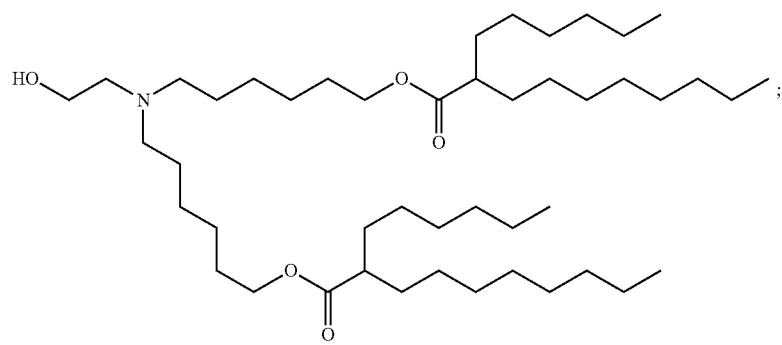

-continued
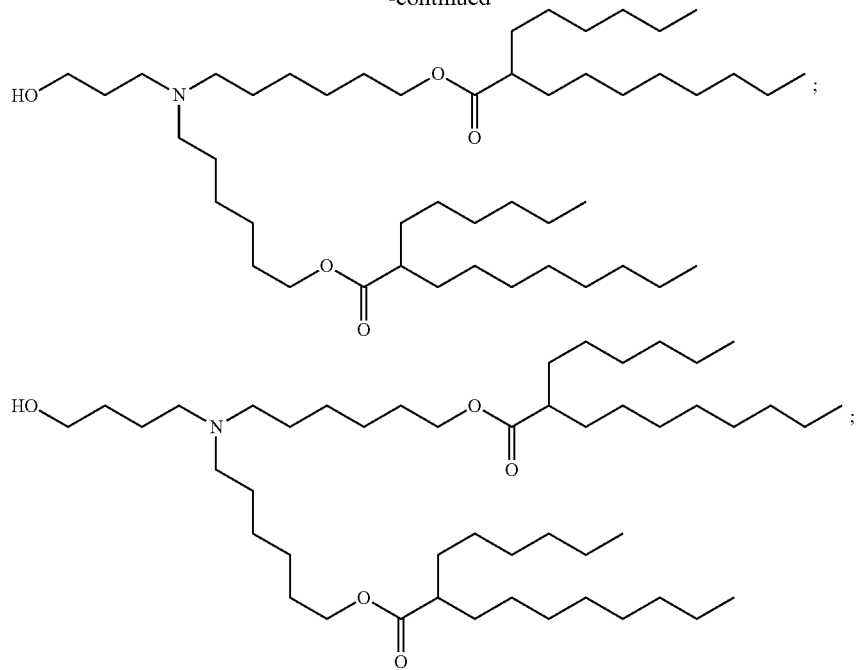
and any combination thereof.
Ionizable lipids can also be the compounds disclosed in International Publication No. WO 2015/199952 A1, hereby incorporated by reference in its entirety. For example, the ionizable amino lipids include, but not limited to:
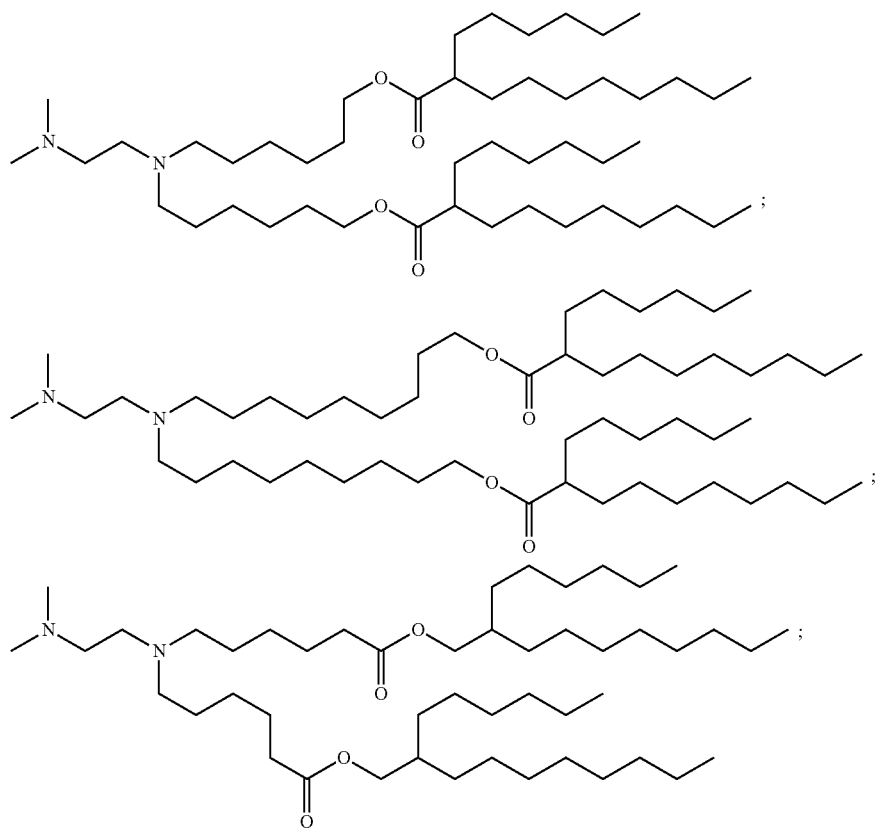

-continued
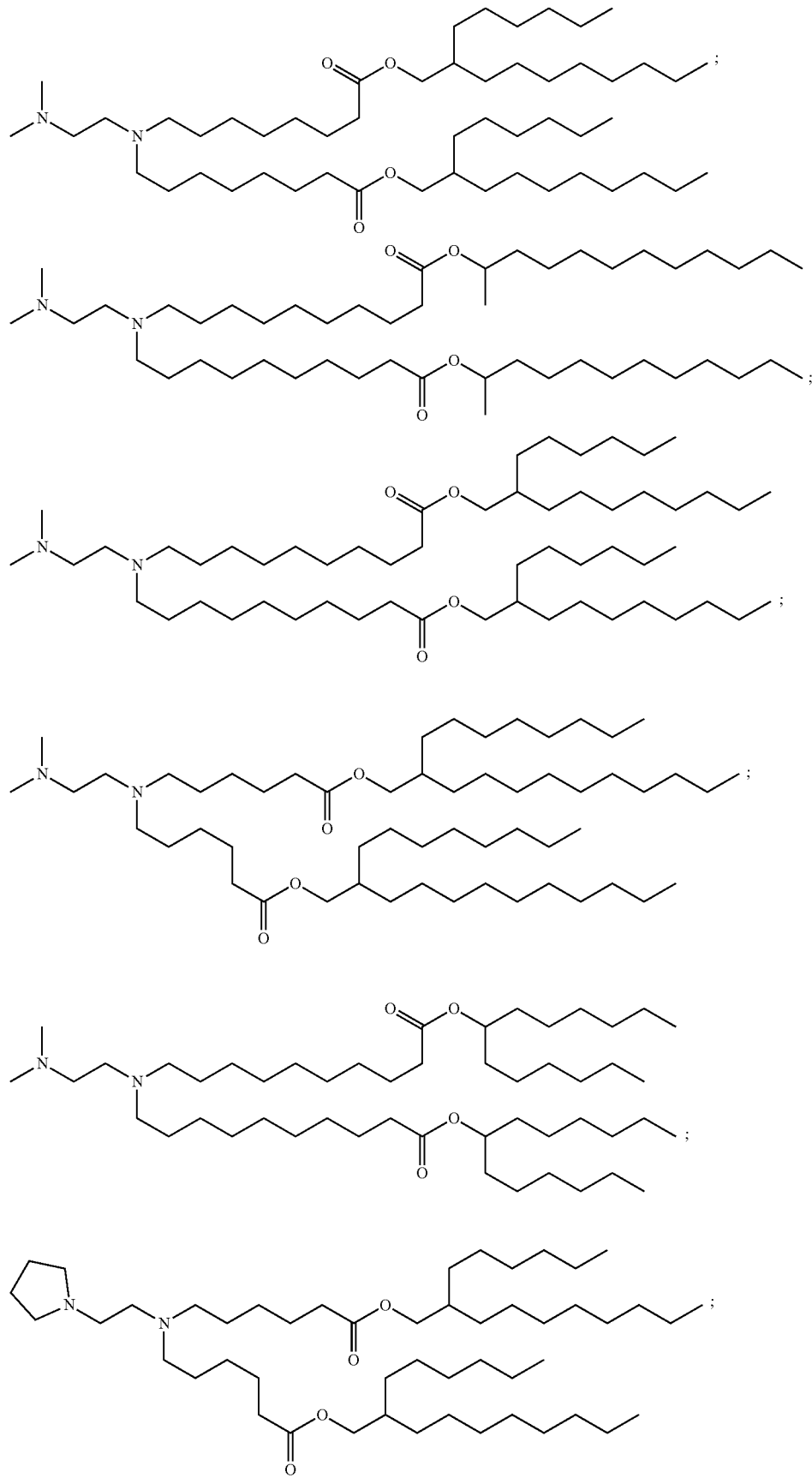

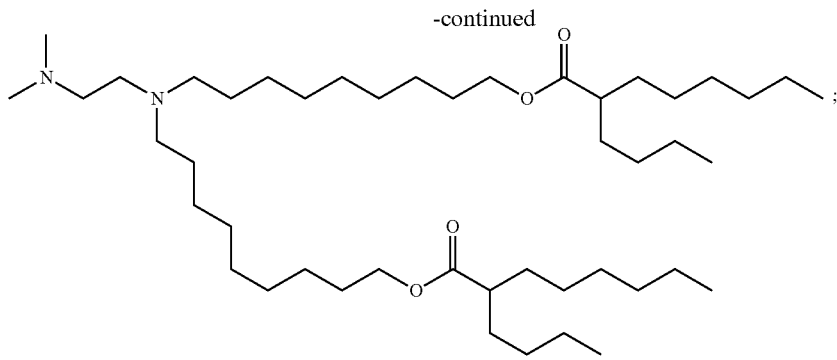

and any combination thereof.

In one embodiment, the ionizable lipid may be selected from, but not limited to, a ionizable lipid described in International Publication Nos. WO2012040184, WO2011153120, WO2011149733, WO2011090965, WO2011043913, WO2011022460, WO2012061259, WO2012054365, WO2012044638, WO2010080724, WO201021865, WO2008103276, WO2013086373 and WO2013086354, U.S. Pat. Nos. 7,893,302, 7,404,969, 8,283,333, and 8,466,122 and US Patent Publication No. US20100036115, US20120202871, US20130064894, US20130129785, US20130150625, US20130178541 and S20130225836; the contents of each of which are herein incorporated by reference in their entirety.

In another embodiment, the ionizable lipid may be selected from, but not limited to, formula A described in International Publication Nos. WO2013116126 or US20130225836; the contents of each of which is herein incorporated by reference in their entirety. In yet another embodiment, the ionizable lipid may be selected from, but not limited to, formula CLI-CLXXIX of International Publication No. WO2008103276, formula CLI-CLXXIX of U.S. Pat. No. 7,893,302, formula CLI-CLXXXXII of U.S. Pat. No. 7,404,969 and formula I-VI of US Patent Publication No. US20100036115, formula I of US Patent Publication No US20130123338; each of which is herein incorporated by reference in their entirety.

As a non-limiting example, a cationic lipid may be selected from (20Z,23Z)-N,N-dimethylnonacosa-20,23-dien-10-amine, (17Z,20Z)-N,N-dimemylhexacosa-17,20-dien-9-amine, (1Z,19Z)-N,N-dimethylpentacosa-1 6, 19-dien-8-amine, (13Z,16Z)-N,N-dimethyldocosa-13,16-dien-5-amine, (12Z,15Z)-N,N dimethylhenicosa-12,15-dien-4-amine, (14Z,17Z)-N,N-dimethyltricosa-14,17-dien-6-amine, (15Z,18Z)-N,N-dimethyltetracosa-15,18-dien-7-amine, (18Z,21Z)-N,N-dimethylheptacosa-18,21-dien-10-amine, (15Z,18Z)-N,N-dimethyltetracosa-15,18-dien-5-amine, (14Z,17Z)-N,N-dimethyltricosa-14,17-dien-4-amine, (19Z,22Z)-N,N-dimeihyloctacosa-19,22-dien-9-amine, (18Z,21Z)-N,N-dimethylheptacosa-18,21-dien-8-amine, (17Z,20Z)-N,N-dimethylhexacosa-17,20-dien-7-amine, (16Z,19Z)-N,N-dimethylpentacosa-16,19-dien-6-amine, (22Z,25Z)-N,N-dimethylhentriaconta-22,25-dien-10-amine, (21Z,24Z)-N,N-dimethyltriaconta-21,24-dien-9-amine, (18Z)-N,N-dimetylheptacos-18-en-10-amine, (17Z)-N,N-dimethylhexacos-17-en-9-amine, (19Z,22Z)-N,N-dimethyloctacosa-19,22-dien-7-amine, N,N-dimethylheptacosan-10-amine, (20Z,23Z)-N-ethyl-N-methylnonacosa-20,23-dien-10-amine, 1-[(11Z,14Z)-1-nonylicosa-11,14-dien-1-yl]pyrrolidine, (20Z)-N,N-dimethylheptacos-20-en-10-amine, (15Z)-N,N-dimethyl eptacos-15-en-10-amine, (14Z)-N,N-dimethylnonacos-14-en-10-amine, (17Z)-N,N-dimethylnonacos-17-en-10-amine, (24Z)-N,N-dimethyltritriacont-24-en-10-amine, (20Z)-N,N-dimethylnonacos-20-en-10-amine, (22Z)-N,N-dimethylhentriacont-22-en-10-amine, (16Z)-N,N-dimethylpentacos-16-en-8-amine, (12Z,15Z)-N,N-dimethyl-2-nonylhenicosa-12,15-dien-1-amine, (13Z,16Z)-N,N-dimethyl-3-nonyldocosa-13,16-dien-1-amine, N,N-dimethyl-1-[(1S,2R)-2-octylcyclopropyl]eptadecan-8-amine, 1-[(1S,2R)-2-hexylcyclopropyl]-N,N-dimethylnonadecan-10-amine, N,N-dimethyl-1-[(1S,2R)-2-octylcyclopropyl]nonadecan-10-amine, N,N-dimethyl-21-[(1S,2R)-2-octylcyclopropyl] henicosan-10-amine,N,N-dimethyl-1-[(1S,2S)-2-{[(1R, 2R)-2-pentylcyclopropyl]methyl}cyclopropyl]nonadecan-10-amine,N,N-dimethyl-1-[(1S,2R)-2-octylcyclopropyl] hexadecan-8-amine, N,N-dimethyl-[(1R,2S)-2 undecylcyclopropyl]tetradecan-5-amine, N,N-dimethyl-3-{7-[(1S,2R)-2-octylcyclopropyl]heptyl}dodecan-1-amine, 1-[(1R,2S)-2-hepty lcyclopropyl]-N,N-dimethyloctadecan-9-amine, 1-[(1S,2R)-2-decylcyclopropyl]-N,N-dimethylpentadecan-6-amine, N,N-dimethyl-1-[(1S,2R)-2-octylcyclopropyl]pentadecan-8-amine, R—N,N-dimethyl-1-[(9Z,12Z)-octadeca-9,12-dien-1-yloxy]-3-(octyloxy)propan-2-amine, S—N,N-dimethyl-1-[(9Z,12Z)-octadeca-9,12-dien-1-yloxy]-3-(octyloxy)propan-2-amine, 1-{2-[(9Z,12Z)-octadeca-9,12-dien-1-yloxy]-1-[((octyloxy)methyl ethyl}pyrrolidine, (2S)—N,N-dimethyl-1-[(9Z,12Z)-octadeca-9,12-dien-1-yloxy]-3-[(5Z)-oct-5-en-1-yloxy] propan-2-amine, 1-{2-[(9Z,12Z)-octadeca-9,12-dien-1-yloxy]-1-[(octyloxy)methyl]ethyl}azetidine, (2S)-1-(hexyloxy)-N,N-dimethyl-3-[(9Z,12Z)-octadeca-9,12-dien-1-yloxy]propan-2-amine, (2S)-1-(heptyloxy)-N,N-dimethyl-3-[(9Z,12Z)-octadeca-9,12-dien-1-yloxy]propan-2-amine, N,N-dimethyl-1-(nonyloxy)-3-[(9Z,12Z)-octadeca-9,12-dien-1-yloxy]propan-2-amine, N,N-dimethyl-1-[(9Z)-octadec-9-en-1-yloxy]-3-(octyloxy) propan-2-amine; (2S)—N,N-dimethyl-1-[(6Z,9Z,12Z)-octadeca-6,9,12-trien-1-yloxy]-3-(octyloxy)propan-2-amine, (2S)-1-[(11Z,14Z)-icosa-11,14-dien-1-yloxy]-N,N-dimethyl-3-(pentyloxy)propan-2-amine, (2S)-1-(hexyloxy)-3-[(11Z,14Z)-icosa-11,14-dien-1-yloxy]-N,N-dimethylpropan-2-amine, 1-[(11Z,14Z)-icosa-11,14-dien-1-yloxy]-N,N-dimethyl-3-(octyloxy)propan-2-amine, 1-[(13Z,16Z)-docosa-13,16-dien-1-yloxy]-N,N-dimethyl-3-(octyloxy)propan-2-amine, (2S)-1-[(13Z,16Z)-docosa-13, 16-dien-1-yloxy]-3-(hexyloxy)-N,N-dimethylpropan-2-amine, (2S)-1-[(13Z)-docos-13-en-1-yloxy]-3-(hexyloxy)-N,N-dimethylpropan-2-amine, 1-[(13Z)-docos-13-en-1- yloxy]-N,N-dimethyl-3-(octyloxy)propan-2-amine, 1-[(9Z)-hexadec-9-en-1-yloxy]-N,N-dimethyl-3-(octyloxy)propan-2-amine, (2R)—N,N-dimethyl-H(1-metoyloctyl)oxy]-3-[(9Z,12Z)-octadeca-9,12-dien-1-yloxy]propan-2-amine, (2R)-1-[(3,7-dimethyloctypoxy]-N,N-dimethyl-3-[(9Z,12Z)-octadeca-9,12-dien-1-yloxy]propan-2-amine, N,N-dimethyl-1-(octyloxy)-3-({8-[(1S,2S)-2-{[(1R,2R)-2-pentylcyclopropyl]methyl}cyclopropyl]octyl}oxy)propan-2-amine, N,N-dimethyl-1-{8-(2-oclylcyclopropyl)octyl]oxy}-3-(octyloxy)propan-2-amine and (11E,20Z,23Z)-N,N-dimethylnonacosa-11,20,2-trien-10-amine or a pharmaceutically acceptable salt or stereoisomer thereof.

Additional examples of ionizable lipids include the following:

In one embodiment, the lipid may be a cleavable lipid such as those described in International Publication No. WO2012170889, herein incorporated by reference in its entirety. In one embodiment, the lipid may be synthesized by methods known in the art and/or as described in International Publication Nos. WO2013086354; the contents of each of which are herein incorporated by reference in their entirety. In another embodiment, the lipid may be a trialkyl cationic lipid. Non-limiting examples of trialkyl cationic lipids and methods of making and using the trialkyl cationic lipids are described in International Patent Publication No. WO2013126803, the contents of which are herein incorporated by reference in its entirety.

In some embodiments, the ionizable lipid may be a compound of Formula (I):

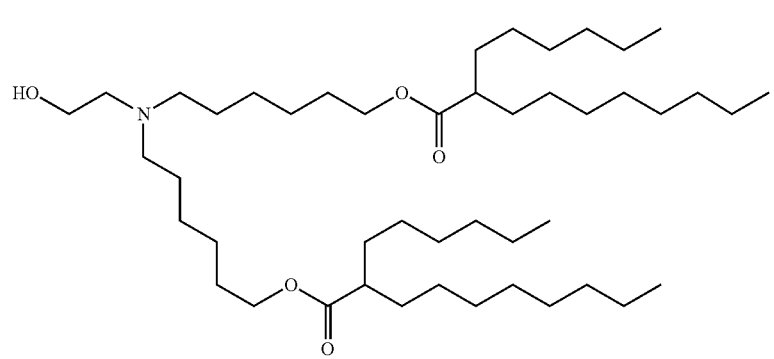

Compound A

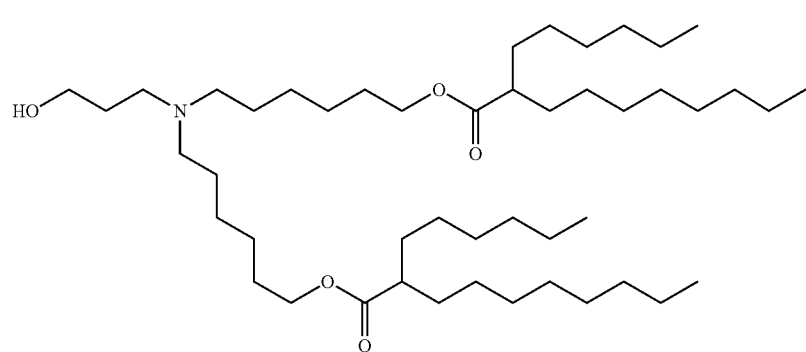

Compound B

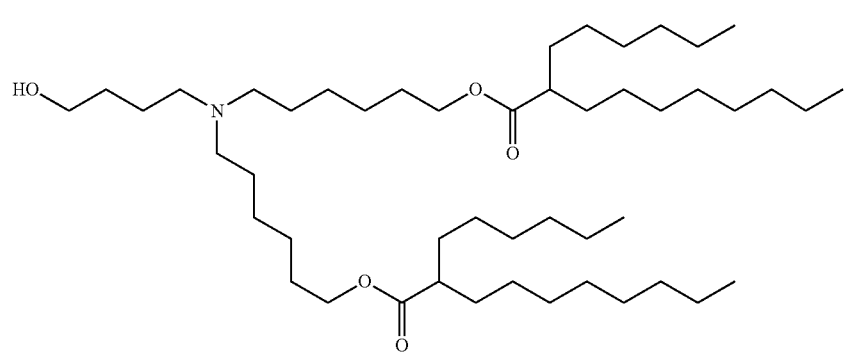

Compound C

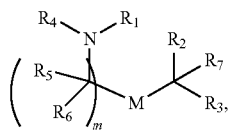

(I)

or a salt or isomer thereof, wherein:

$R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, —(CH$_2$)$_n$Q, —(CH$_2$)$_n$CHQR, —CHQR, —CQ(R)$_2$, and unsubstituted $C_{1-6}$ alkyl, where Q is selected from a carbocycle, heterocycle, —OR, —O(CH$_2$)$_n$N(R)$_2$, —C(O)OR, —OC(O)R, —CX$_3$, —CX$_2$H, —CXH$_2$, —CN, —N(R)$_2$, —C(O)N(R)$_2$, —N(R)C(O)R, —N(R)S(O)$_2$R, —N(R)C(O)N(R)$_2$, —N(R)C(S)N(R)$_2$, —N(R)R$_8$, —O(CH$_2$)$_n$OR, —N(R)C(=NR$_9$)N(R)$_2$, —N(R)C(=CHR$_9$)N(R)$_2$, —OC(O)N(R)$_2$, —N(R)C(O)OR, —N(OR)C(O)R, —N(OR)S(O)$_2$R, —N(OR)C(O)OR, —N(OR)C(O)N(R)$_2$, —N(OR)C(S)N(R)$_2$, —N(OR)C(=NR$_9$)N(R)$_2$, —N(OR)C(=CHR$_9$)N(R)$_2$, —C(=NR$_9$)N(R)$_2$, —C(=NR$_9$)R, —C(O)N(R)OR, and —C(R)N(R)$_2$C(O)OR, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, NO$_2$, $C_{1-6}$ alkyl, —OR, —S(O)$_2$R, —S(O)$_2$N(R)$_2$, $C_{2-6}$ alkenyl, $C_{3-6}$ carbocycle and heterocycle;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13.

In some embodiments, a subset of compounds of Formula (I) includes those in which when $R_4$ is —(CH$_2$)$_n$Q, —(CH$_2$)$_n$CHQR, —CHQR, or —CQ(R)$_2$, then (i) Q is not —N(R)$_2$ when n is 1, 2, 3, 4 or 5, or (ii) Q is not 5, 6, or 7-membered heterocycloalkyl when n is 1 or 2.

In some embodiments, another subset of compounds of Formula (I) includes those in which $R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, —(CH$_2$)$_n$Q, —(CH$_2$)$_n$CHQR, —CHQR, —CQ(R)$_2$, and unsubstituted $C_{1-6}$ alkyl, where Q is selected from a $C_{3-6}$ carbocycle, a 5- to 14-membered heteroaryl having one or more heteroatoms selected from N, O, and S, —OR, —O(CH$_2$)$_n$N(R)$_2$, —C(O)OR, —OC(O)R, —CX$_3$, —CX$_2$H, —CXH$_2$, —CN, —C(O)N(R)$_2$, —N(R)C(O)R, —N(R)S(O)$_2$R, —N(R)C(O)N(R)$_2$, —N(R)C(S)N(R)$_2$, —CRN(R)$_2$C(O)OR, —N(R)R$_8$, —O(CH$_2$)$_n$OR, —N(R)C(=NR$_9$)N(R)$_2$, —N(R)C(=CHR$_9$)N(R)$_2$, —OC(O)N(R)$_2$, —N(R)C(O)OR, —N(OR)C(O)R, —N(OR)S(O)$_2$R, —N(OR)C(O)OR, —N(OR)C(O)N(R)$_2$, —N(OR)C(S)N(R)$_2$, —N(OR)C(=NR$_9$)N(R)$_2$, —N(OR)C(=CHR$_9$)N(R)$_2$, —C(=NR$_9$)N(R)$_2$, —C(=NR$_9$)R, —C(O)N(R)OR, and a 5- to 14-membered heterocycloalkyl having one or more heteroatoms selected from N, O, and S which is substituted with one or more substituents selected from oxo (=O), OH, amino, mono- or di-alkylamino, and $C_{1-3}$ alkyl, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, NO$_2$, $C_{1-6}$ alkyl, —OR, —S(O)$_2$R, —S(O)$_2$N(R)$_2$, $C_{2-6}$ alkenyl, $C_{3-6}$ carbocycle and heterocycle;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

In some embodiments, another subset of compounds of Formula (I) includes those in which $R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, —$(CH_2)_nQ$, —$(CH_2)_n$CHQR, —CHQR, —CQ$(R)_2$, and unsubstituted $C_{1-6}$ alkyl, where Q is selected from a $C_{3-6}$ carbocycle, a 5- to 14-membered heterocycle having one or more heteroatoms selected from N, O, and S, —OR, —$O(CH_2)_nN(R)_2$, —C(O)OR, —OC(O)R, —$CX_3$, —$CX_2H$, —$CXH_2$, —CN, —C(O)N(R)_2, —N(R)C(O)R, —N(R)S(O)_2R, —N(R)C(O)N(R)_2, —N(R)C(S)N(R)_2, —CRN(R)_2C(O)OR, —N(R)R_8, —$O(CH_2)_nOR$, —N(R)C(=NR_9)N(R)_2, —N(R)C(=CHR_9)N(R)_2, —OC(O)N(R)_2, —N(R)C(O)OR, —N(OR)C(O)R, —N(OR)S(O)_2R, —N(OR)C(O)OR, —N(OR)C(O)N(R)_2, —N(OR)C(S)N(R)_2, —N(OR)C(=NR_9)N(R)_2, —N(OR)C(=CHR_9)N(R)_2, —C(=NR_9)R, —C(O)N(R)OR, and —C(=NR_9)N(R)_2, and each n is independently selected from 1, 2, 3, 4, and 5; and when Q is a 5- to 14-membered heterocycle and (i) $R_4$ is —$(CH_2)_nQ$ in which n is 1 or 2, or (ii) $R_4$ is —$(CH_2)_n$CHQR in which n is 1, or (iii) $R_4$ is —CHQR, and —CQ(R)_2, then Q is either a 5- to 14-membered heteroaryl or 8- to 14-membered heterocycloalkyl;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)_2—, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, $NO_2$, $C_{1-6}$ alkyl, —OR, —S(O)_2R, —S(O)_2N(R)_2, $C_{2-6}$ alkenyl, $C_{3-6}$ carbocycle and heterocycle;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

In some embodiments, another subset of compounds of Formula (I) includes those in which $R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, —$(CH_2)_nQ$, —$(CH_2)_n$CHQR, —CHQR, —CQ$(R)_2$, and unsubstituted $C_{1-6}$ alkyl, where Q is selected from a $C_{3-6}$ carbocycle, a 5- to 14-membered heteroaryl having one or more heteroatoms selected from N, O, and S, —OR, —$O(CH_2)_nN(R)_2$, —C(O)OR, —OC(O)R, —$CX_3$, —$CX_2H$, —$CXH_2$, —CN, —C(O)N(R)_2, —N(R)C(O)R, —N(R)S(O)_2R, —N(R)C(O)N(R)_2, —N(R)C(S)N(R)_2, —CRN(R)_2C(O)OR, —N(R)R_8, —$O(CH_2)_nOR$, —N(R)C(=NR_9)N(R)_2, —N(R)C(=CHR_9)N(R)_2, —OC(O)N(R)_2, —N(R)C(O)OR, —N(OR)C(O)R, —N(OR)S(O)_2R, —N(OR)C(O)OR, —N(OR)C(O)N(R)_2, —N(OR)C(S)N(R)_2, —N(OR)C(=NR_9)N(R)_2, —N(OR)C(=CHR_9)N(R)_2, —C(=NR_9)R, —C(O)N(R)OR, and —C(=NR_9)N(R)_2, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)_2—, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, $NO_2$, $C_{1-6}$ alkyl, —OR, —S(O)_2R, —S(O)_2N(R)_2, $C_{2-6}$ alkenyl, $C_{3-6}$ carbocycle and heterocycle;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

In some embodiments, another subset of compounds of Formula (I) includes those in which $R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of H, $C_{2-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is —$(CH_2)_nQ$ or —$(CH_2)_n$CHQR, where Q is —N$(R)_2$, and n is selected from 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)_2—, —S—S—, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{1-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

In some embodiments, another subset of compounds of Formula (I) includes those in which $R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of —$(CH_2)_nQ$, —$(CH_2)_n$CHQR, —CHQR, and —$CQ(R)_2$, where Q is —$N(R)_2$, and n is selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{1-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

In some embodiments, a subset of compounds of Formula (I) includes those of Formula (IA):

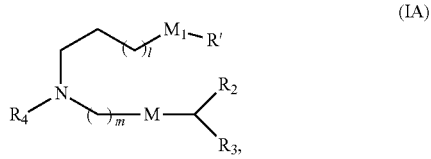

(IA)

or a salt or isomer thereof, wherein l is selected from 1, 2, 3, 4, and 5; m is selected from 5, 6, 7, 8, and 9; $M_1$ is a bond or M'; $R_4$ is unsubstituted $C_{1-3}$ alkyl, or —$(CH_2)_nQ$, in which Q is OH, —NHC(S)N(R)$_2$, —NHC(O)N(R)$_2$, —N(R)C(O)R, —N(R)S(O)$_2$R, —N(R)R$_8$, —NHC(=NR$_9$)N(R)$_2$, —NHC(=CHR$_9$)N(R)$_2$, —OC(O)N(R)$_2$, —N(R)C(O)OR, heteroaryl or heterocycloalkyl; M and M' are independently selected from —C(O)O—, —OC(O)—, —C(O)N(R')—, —P(O)(OR')O—, —S—S—, an aryl group, and a heteroaryl group; and $R_2$ and $R_3$ are independently selected from the group consisting of H, $C_{1-14}$ alkyl, and $C_{2-14}$ alkenyl.

In some embodiments, a subset of compounds of Formula (I) includes those of Formula (II):

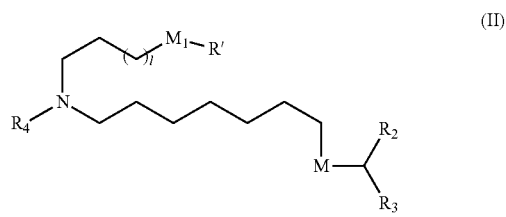

(II)

or a salt or isomer thereof, wherein l is selected from 1, 2, 3, 4, and 5; $M_1$ is a bond or M'; $R_4$ is unsubstituted $C_{1-3}$ alkyl, or —$(CH_2)_nQ$, in which n is 2, 3, or 4, and Q is OH, —NHC(S)N(R)$_2$, —NHC(O)N(R)$_2$, —N(R)C(O)R, —N(R)S(O)$_2$R, —N(R)R$_8$, —NHC(=NR$_9$)N(R)$_2$, —NHC(=CHR$_9$)N(R)$_2$, —OC(O)N(R)$_2$, —N(R)C(O)OR, heteroaryl or heterocycloalkyl; M and M' are independently selected from —C(O)O—, —OC(O)—, —C(O)N(R')—, —P(O)(OR')O—, —S—S—, an aryl group, and a heteroaryl group; and $R_2$ and $R_3$ are independently selected from the group consisting of H, $C_{1-14}$ alkyl, and $C_{2-14}$ alkenyl.

In some embodiments, a subset of compounds of Formula (I) includes those of Formula (IIa), (IIb), (IIc), or (IIe):

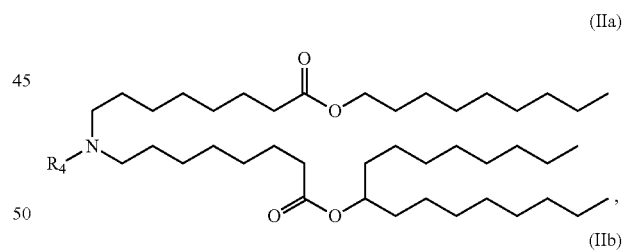

(IIa)

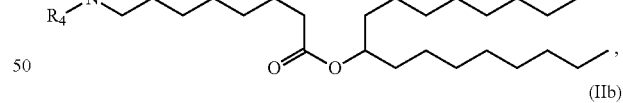

(IIb)

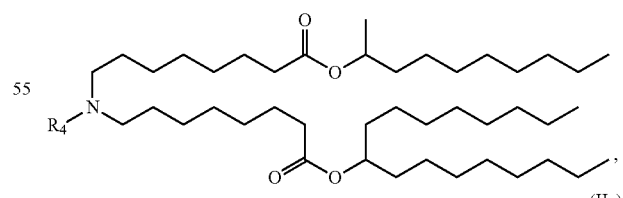

(IIc)

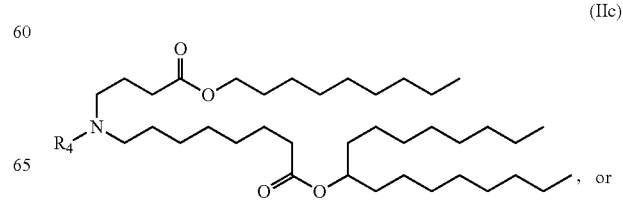

, or

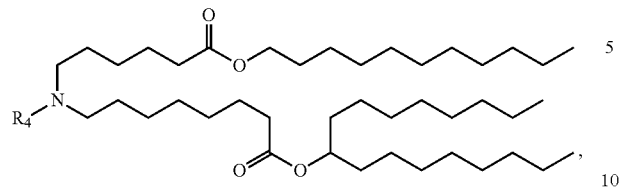
(IIe)

or a salt or isomer thereof, wherein $R_4$ is as described herein.

In some embodiments, a subset of compounds of Formula (I) includes those of Formula (IId):

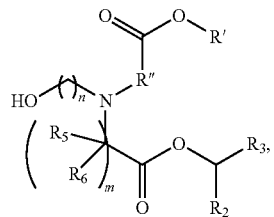
(IId)

or a salt or isomer thereof, wherein n is 2, 3, or 4; and m, R', R", and $R_2$ through $R_6$ are as described herein. For example, each of $R_2$ and $R_3$ may be independently selected from the group consisting of $C_{5-14}$ alkyl and $C_{5-14}$ alkenyl.

In some embodiments, the compound of Formula (I) is selected from the group consisting of:

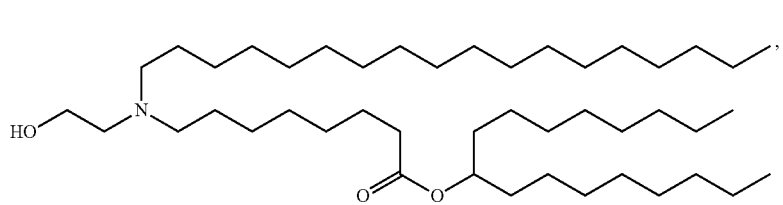
(Compound 1)

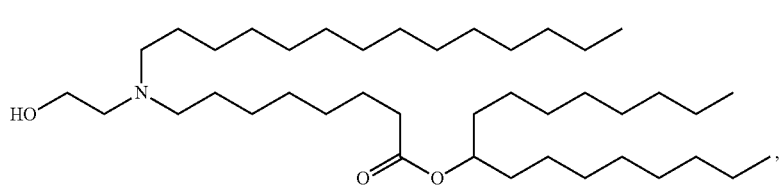
(Compound 2)

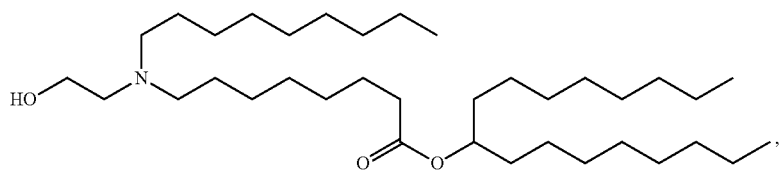
(Compound 3)

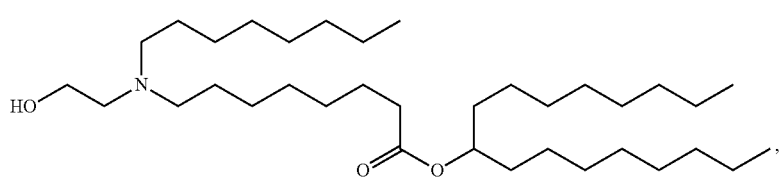
(Compound 4)

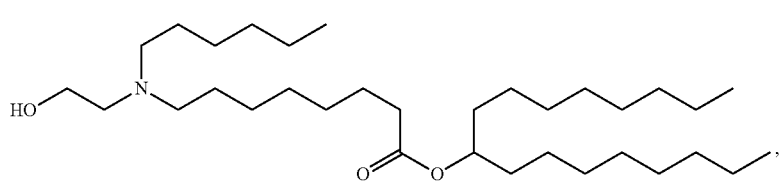
(Compound 5)

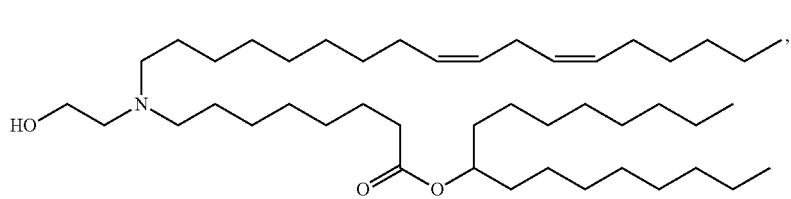
(Compound 6)

-continued
(Compound 7)
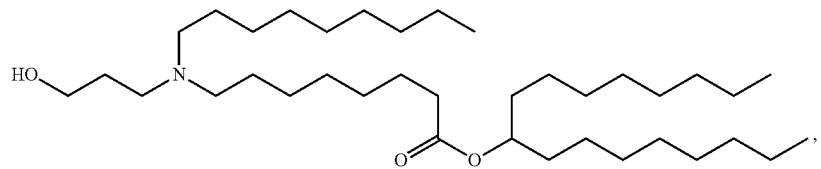
(Compound 8)
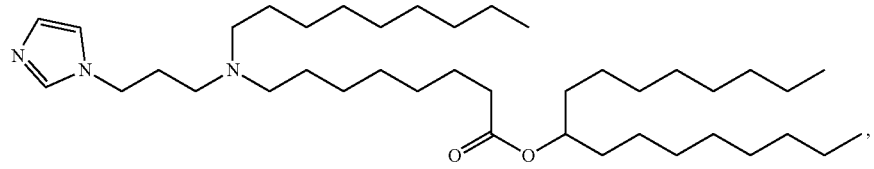
(Compound 9)
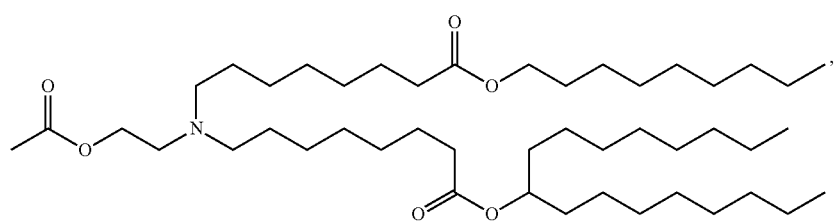
(Compound 10)
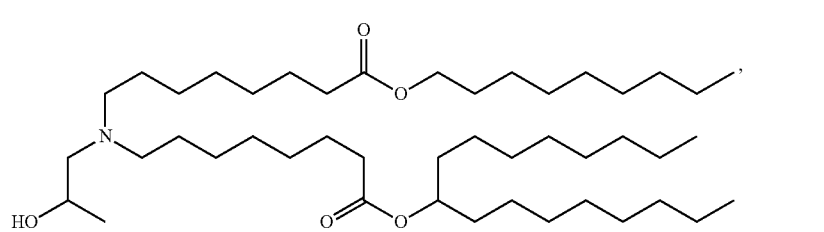
(Compound 11)
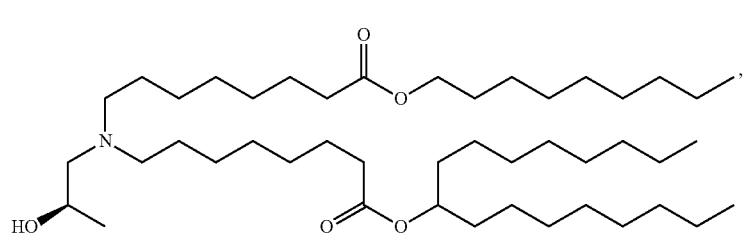
(Compound 12)
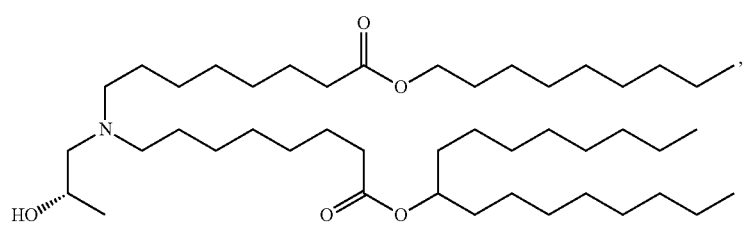
(Compound 13)
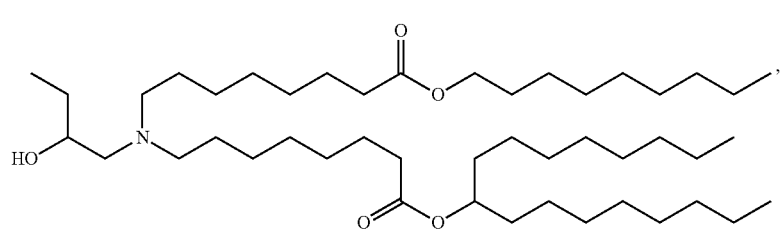

-continued
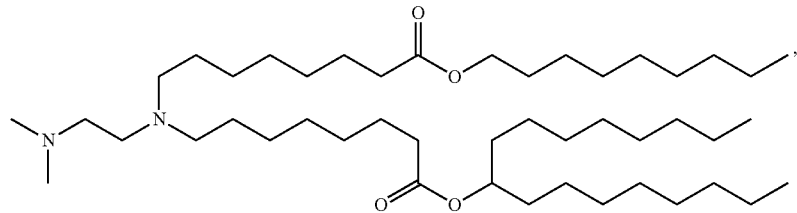
(Compound 14)
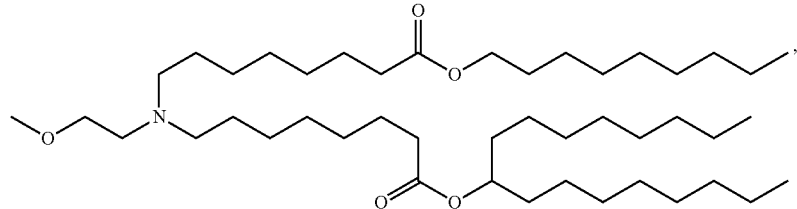
(Compound 15)
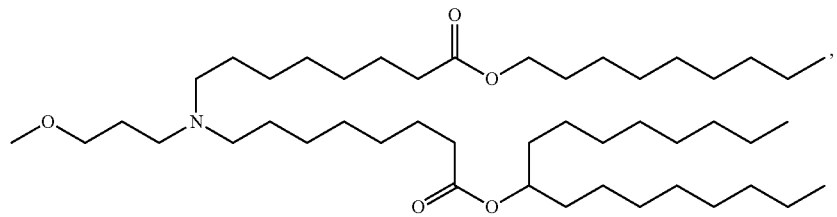
(Compound 16)
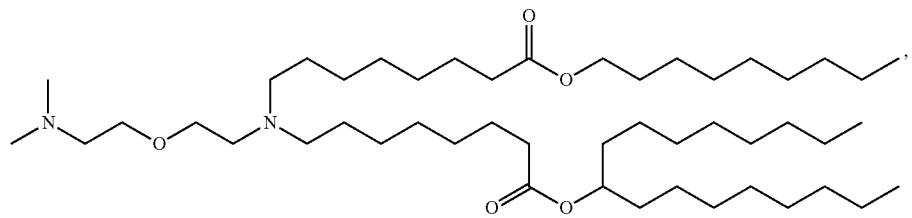
(Compound 17)
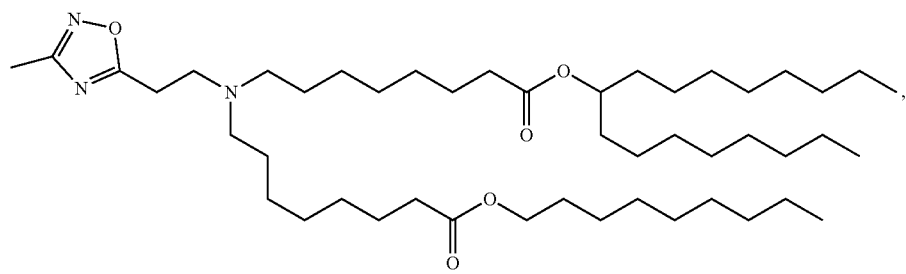
(Compound 230)
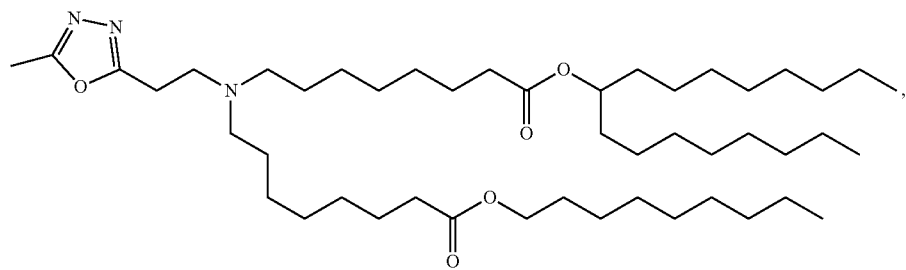
(Compound 231)

-continued
(Compound 18)
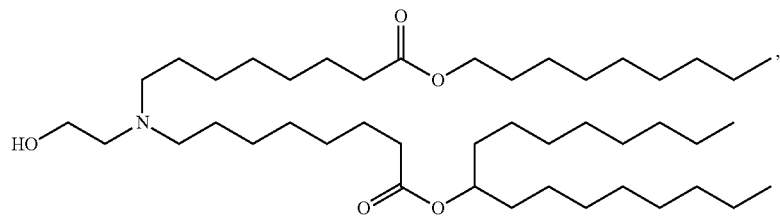
(Compound 19)
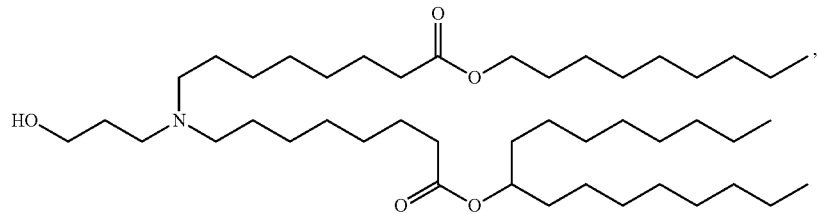
(Compound 20)
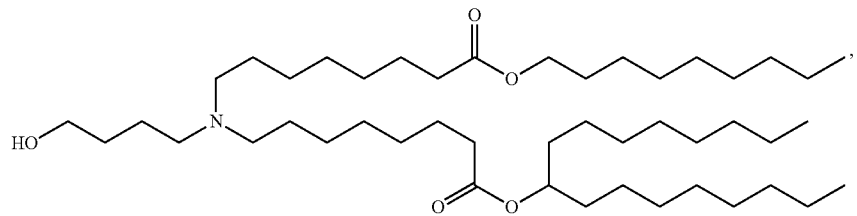
(Compound 21)
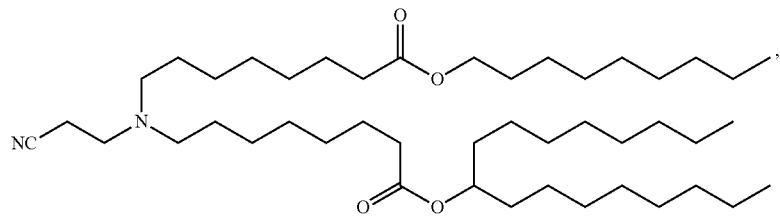
(Compound 22)
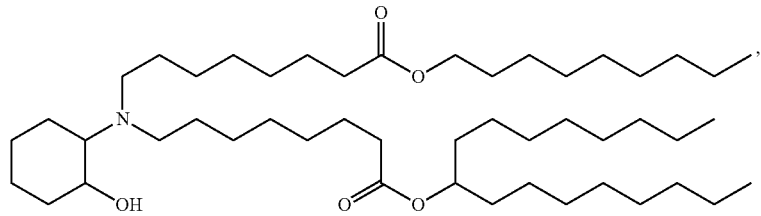
(Compound 23)
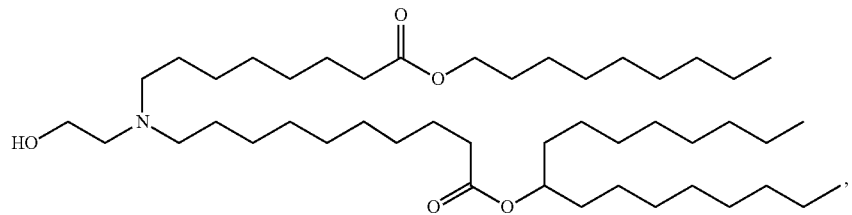
(Compound 24)
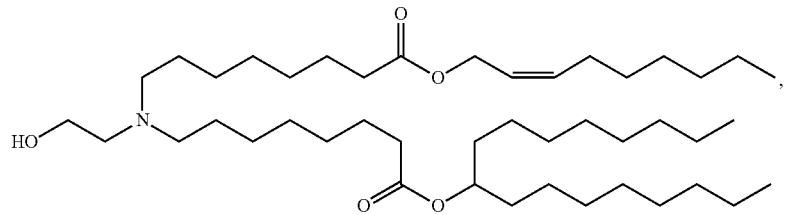

(Compound 25)
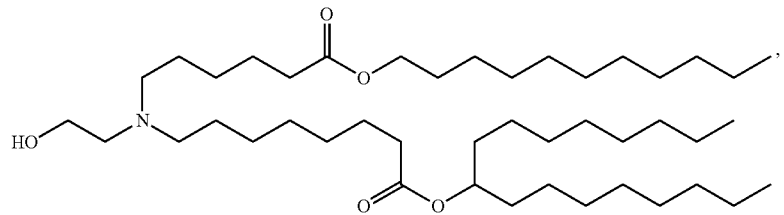
(Compound 26)
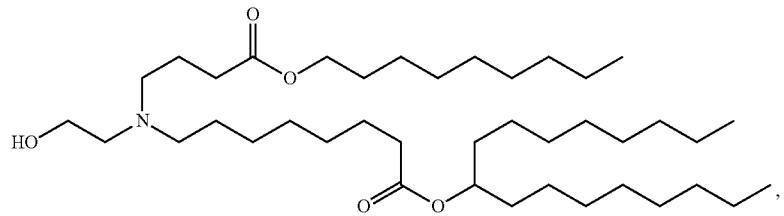
(Compound 27)
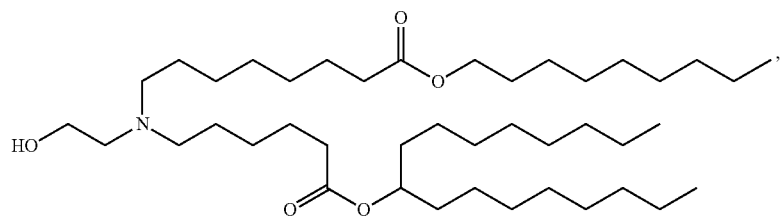
(Compound 28)
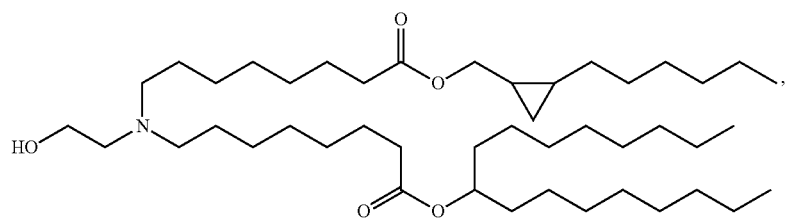
(Compound 29)
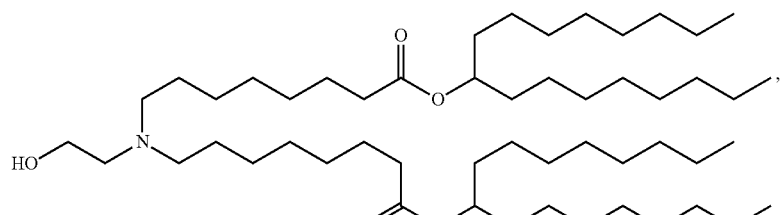
(Compound 30)
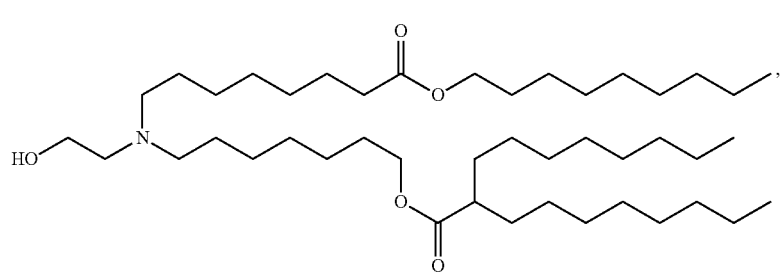
(Compound 31)
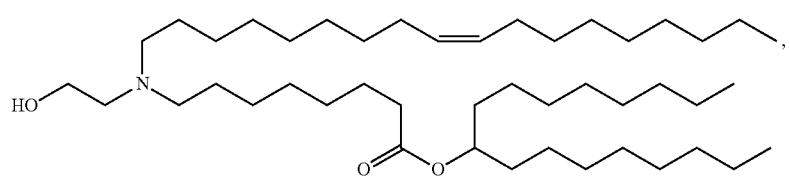

(Compound 32)
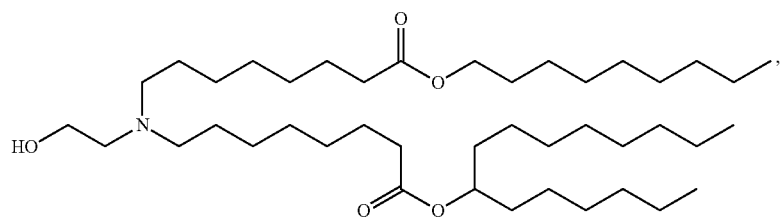
(Compound 33)
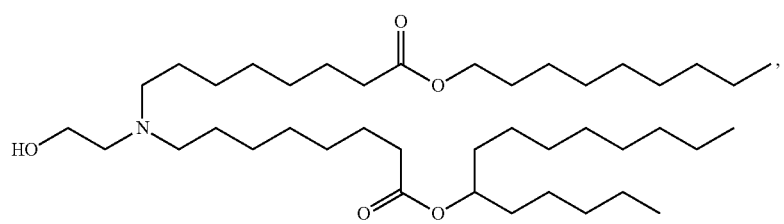
(Compound 34)
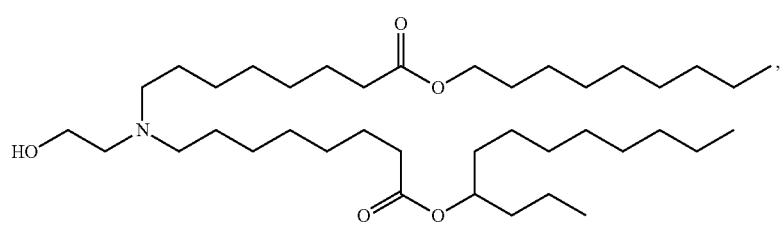
(Compound 35)
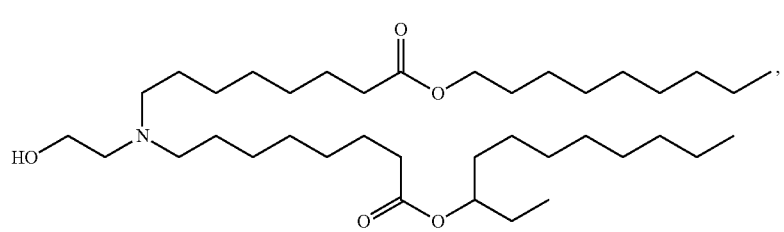
(Compound 36)
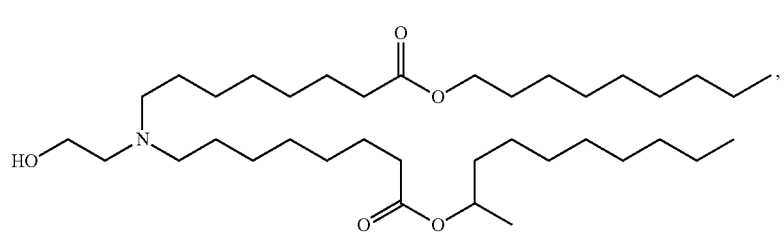
(Compound 37)
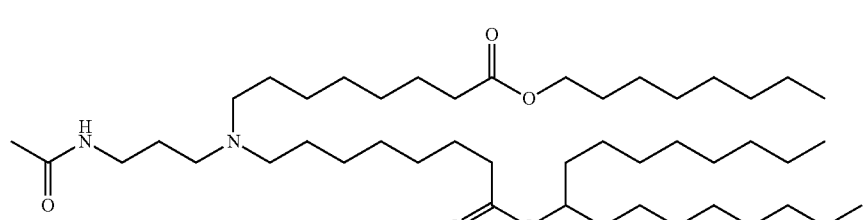
(Compound 38)
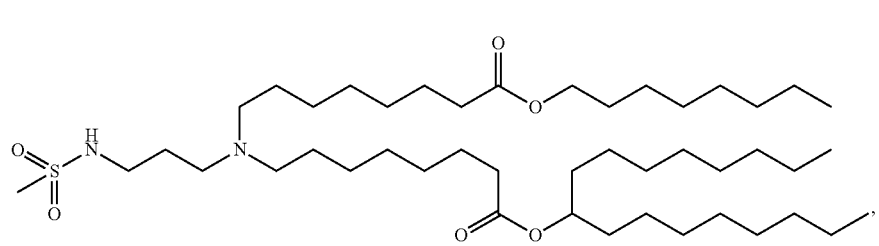

-continued
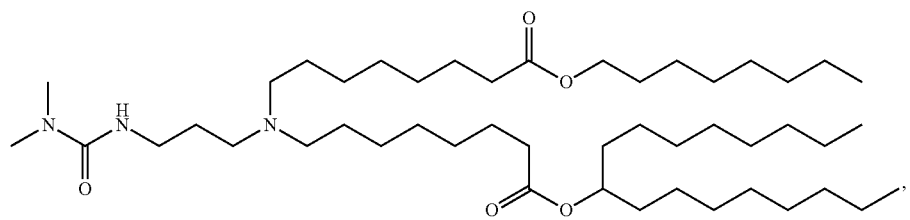
(Compound 39)
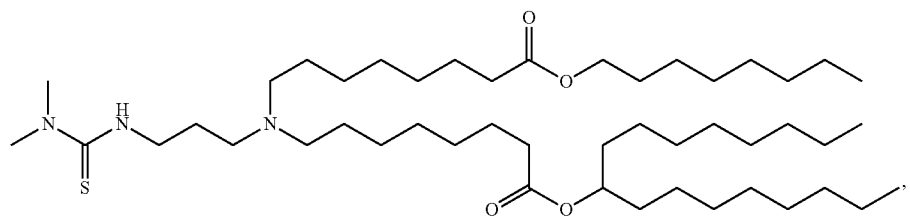
(Compound 40)
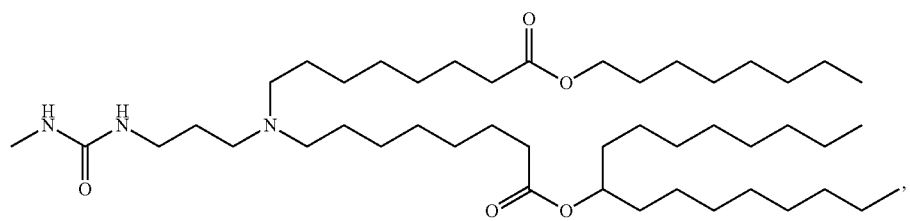
(Compound 41)
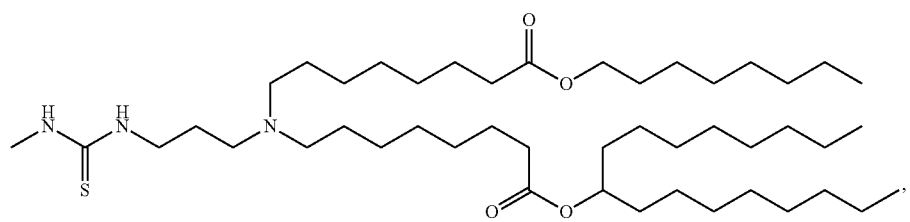
(Compound 42)
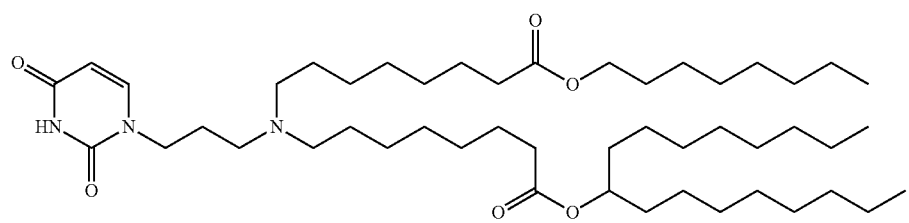
(Compound 43)
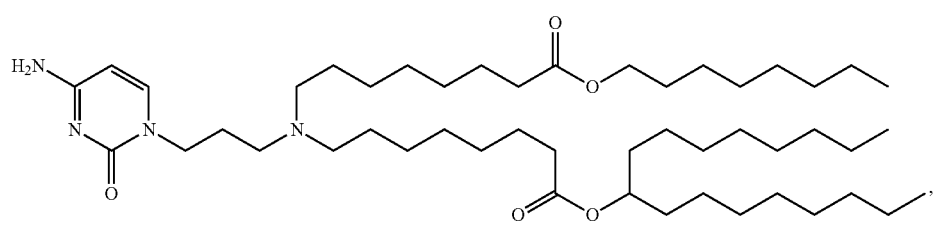
(Compound 44)

(Compound 45)
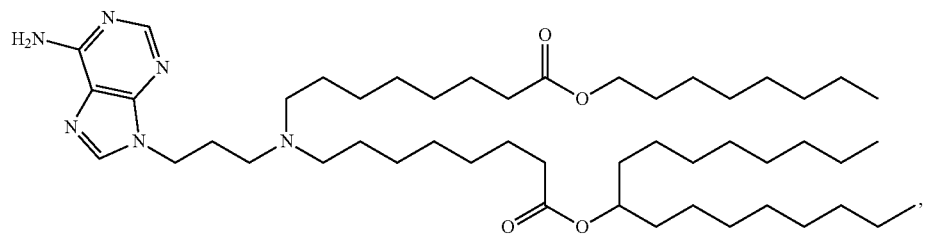
(Compound 46)
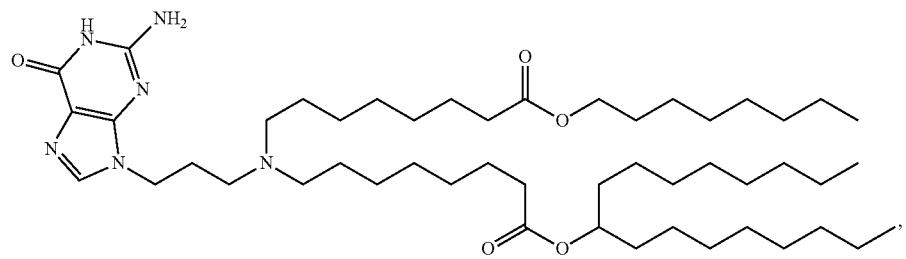
(Compound 47)
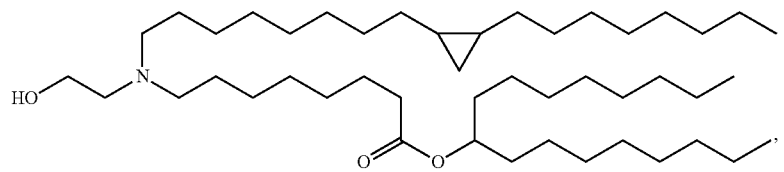
(Compound 48)
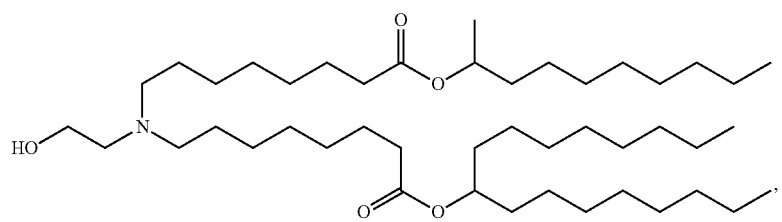
(Compound 49)
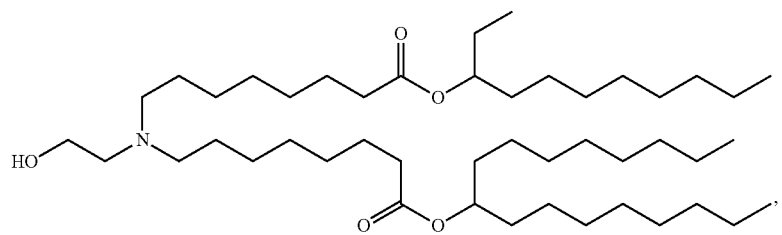
(Compound 50)
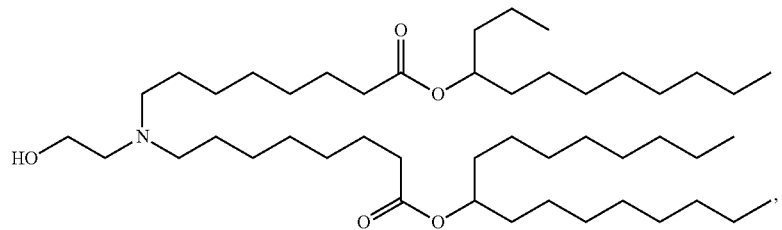
(Compound 51)
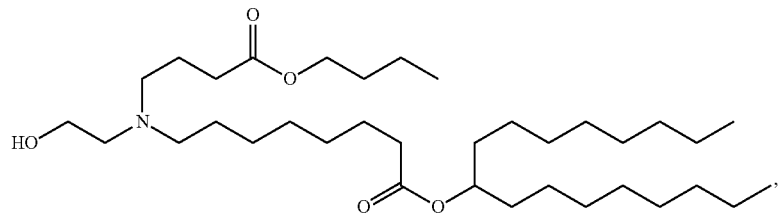

(Compound 52)
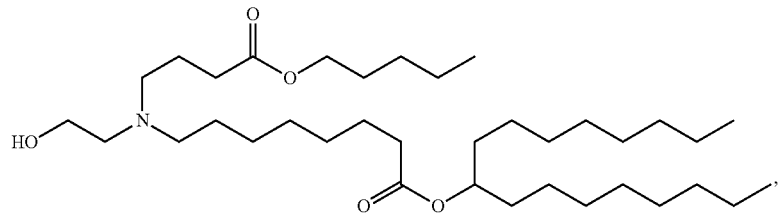
(Compound 53)
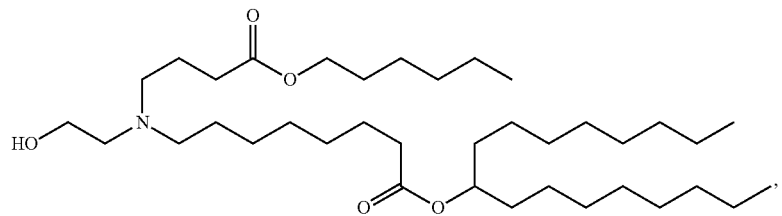
(Compound 54)
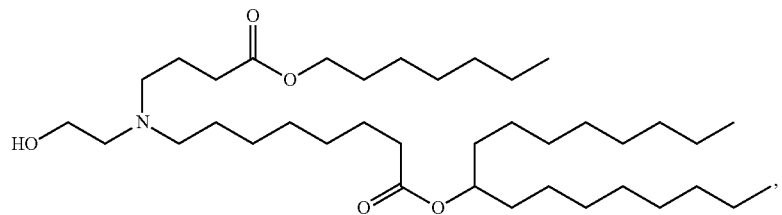
(Compound 55)
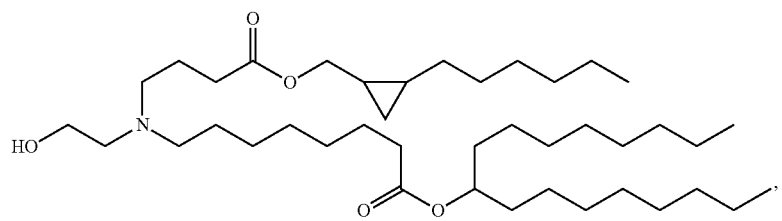
(Compound 56)
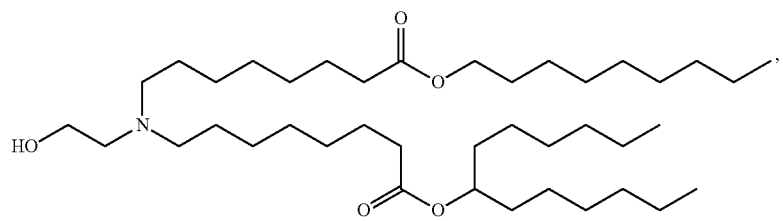
(Compound 57)
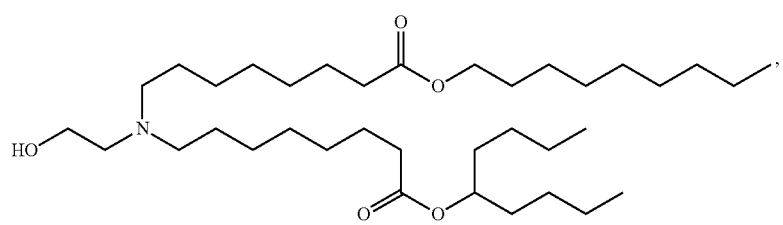
(Compound 58)
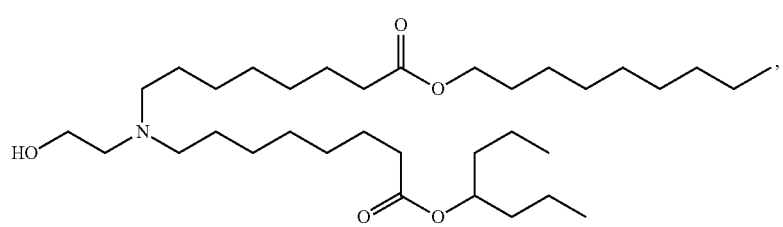

(Compound 59)
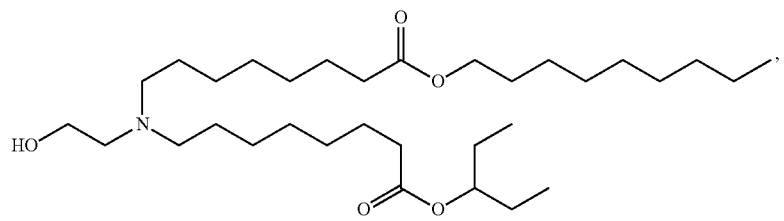
(Compound 60)
(Compound 61)
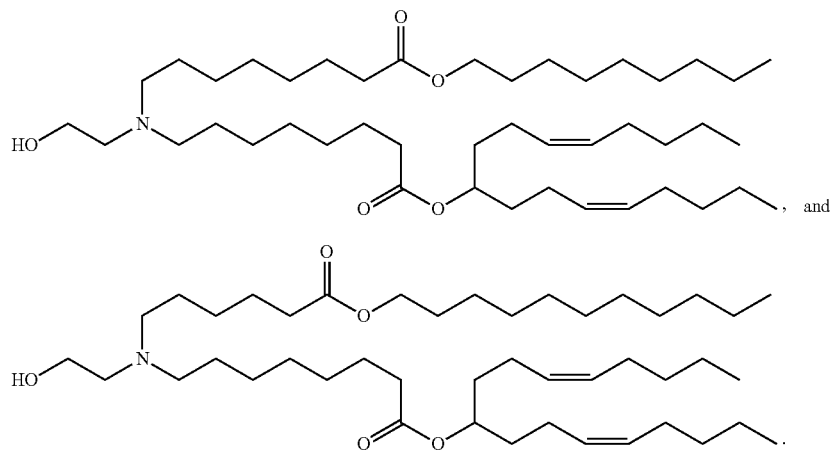
In further embodiments, the compound of Formula (I) is selected from the group consisting of:
(Compound 62)
(Compound 63)
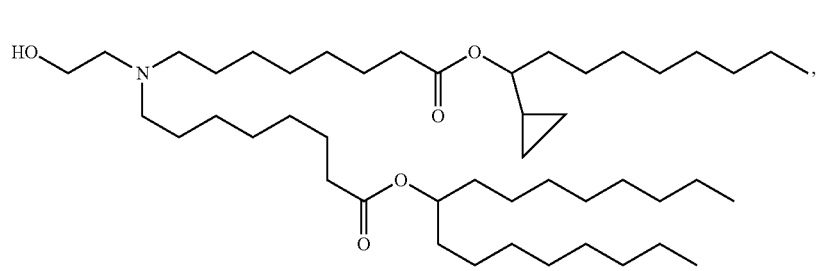
(Compound 64)
In some embodiments, the compound of Formula (I) is selected from the group consisting of:
(Compound 65)
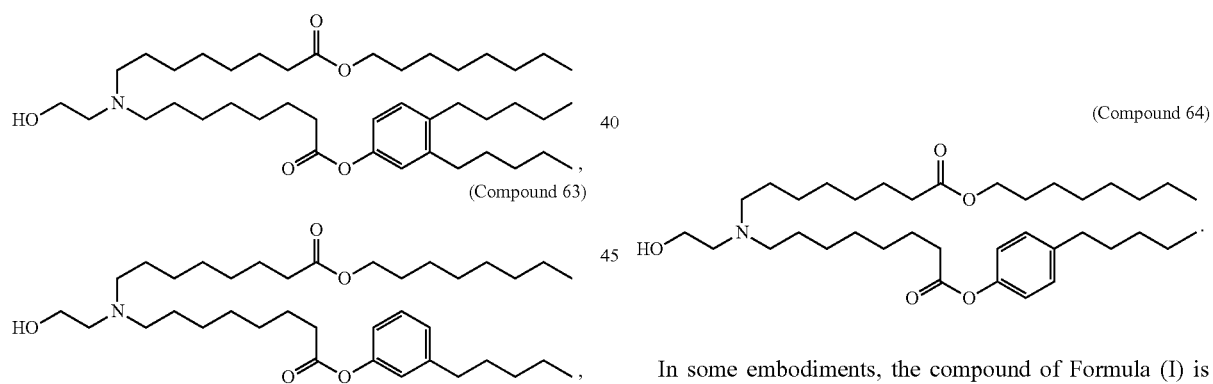

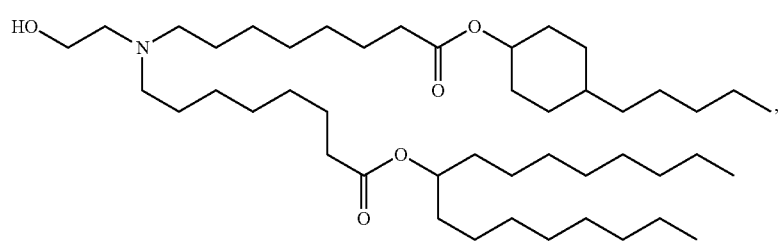
(Compound 66)
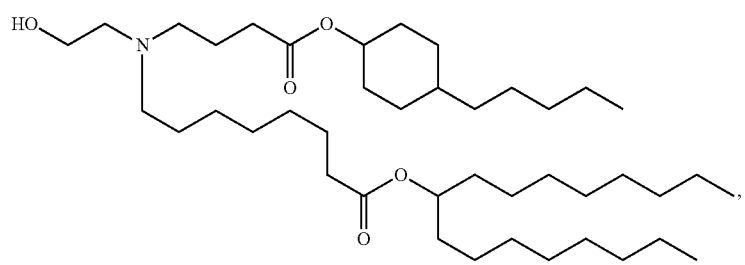
(Compound 67)
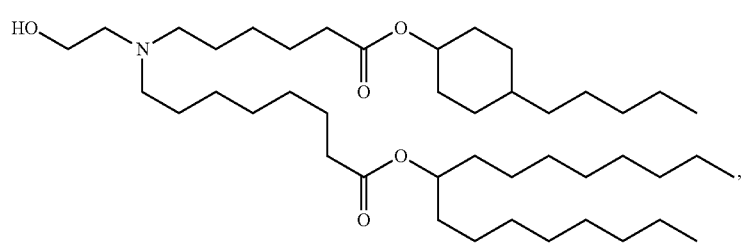
(Compound 68)
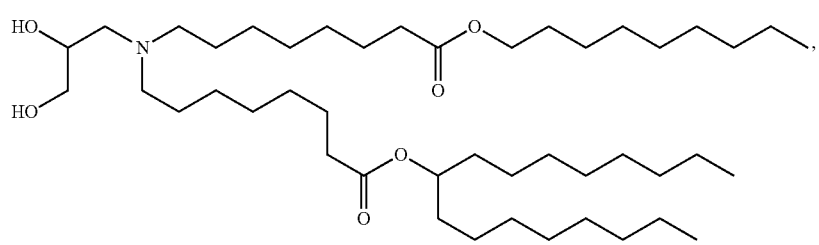
(Compound 69)
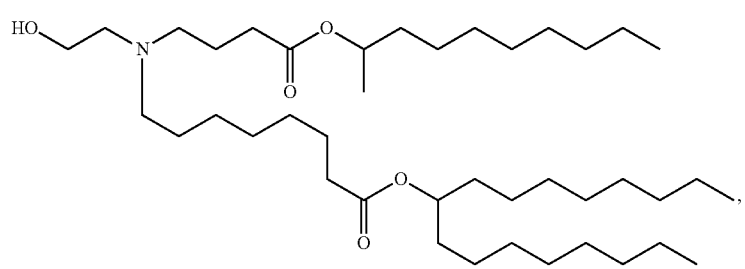
(Compound 70)
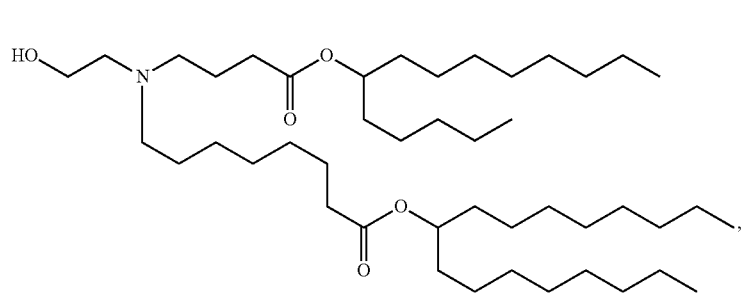
(Compound 71)

(Compound 72)
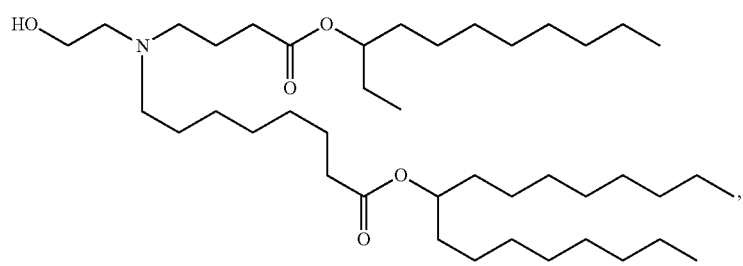
(Compound 73)
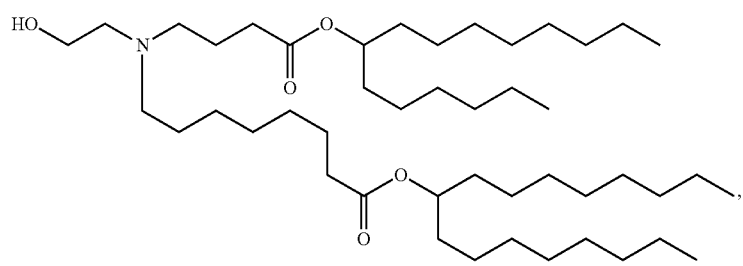
(Compound 74)
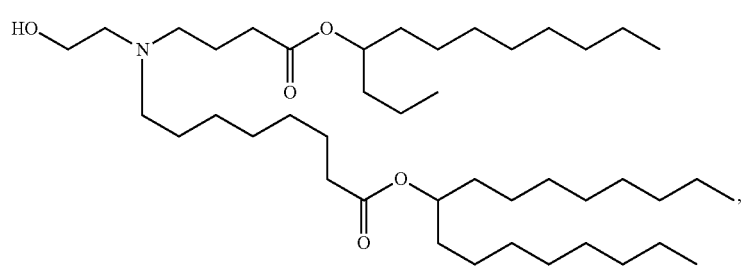
(Compound 75)
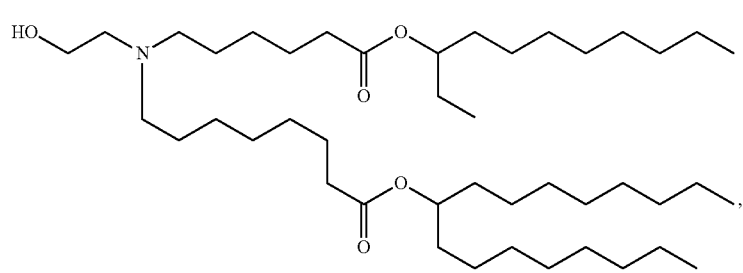
(Compound 76)
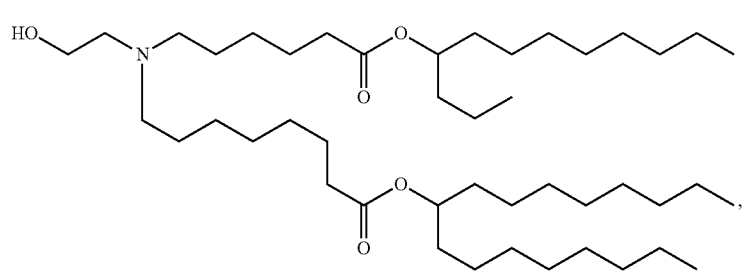
(Compound 77)
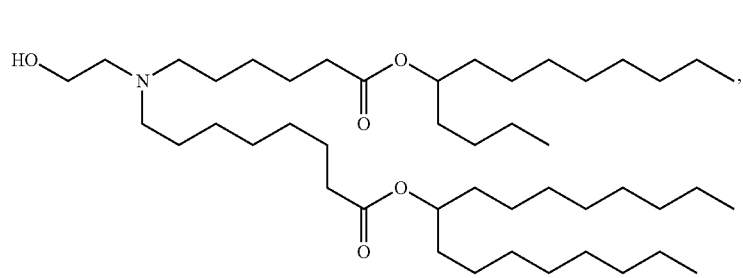

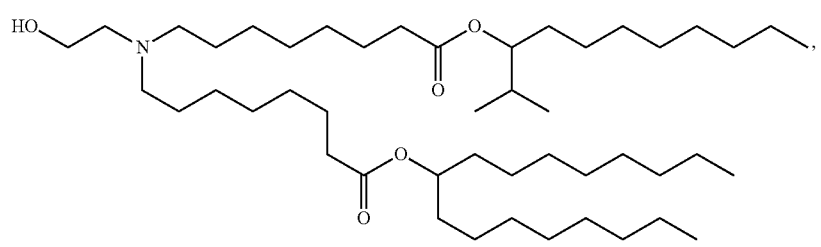
(Compound 78)
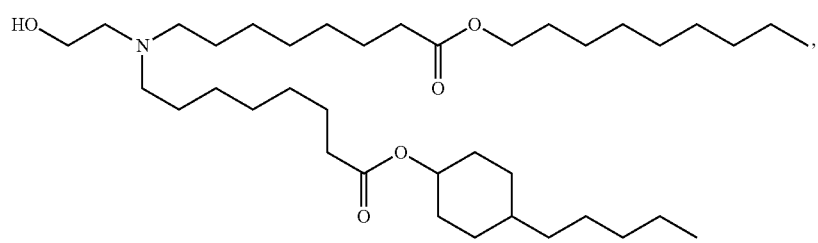
(Compound 79)
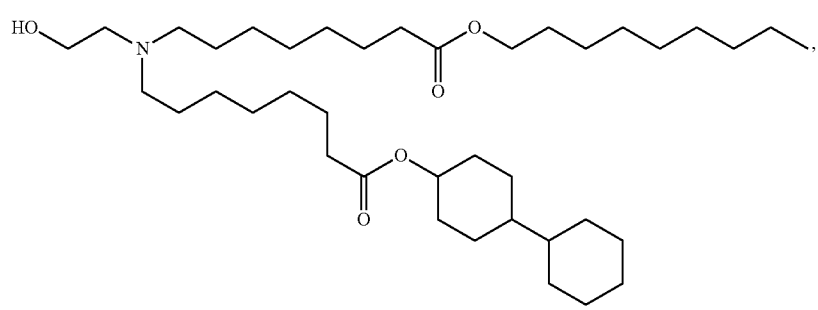
(Compound 80)
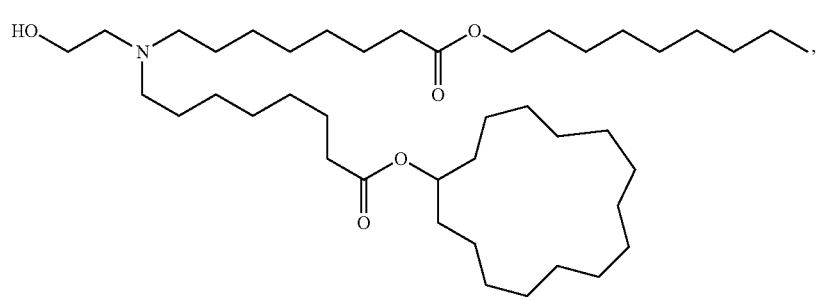
(Compound 81)
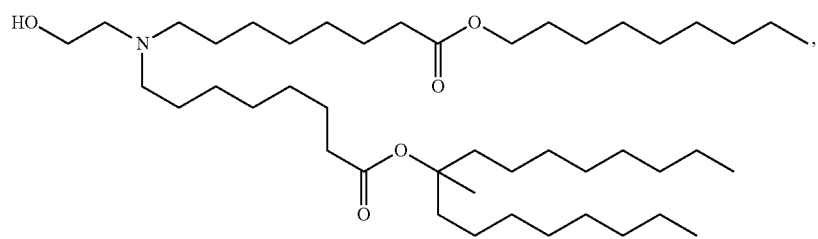
(Compound 82)
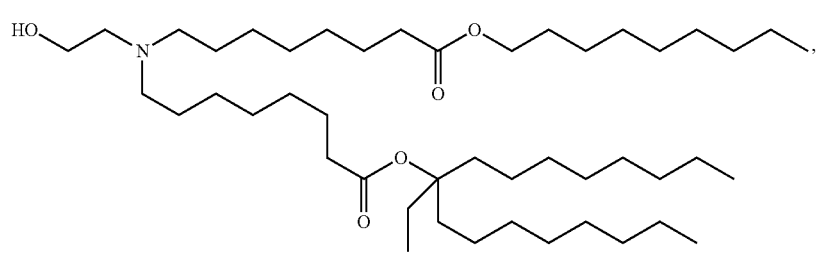
(Compound 83)

-continued
(Compound 84)
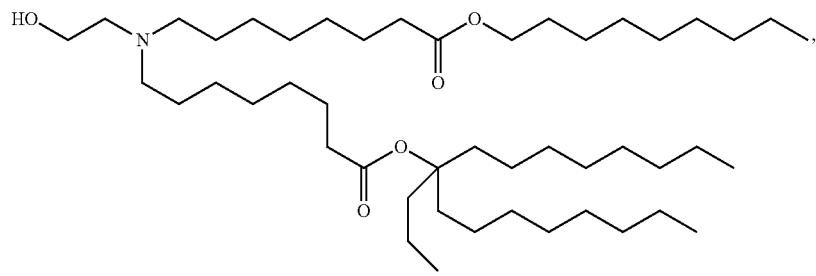
(Compound 85)
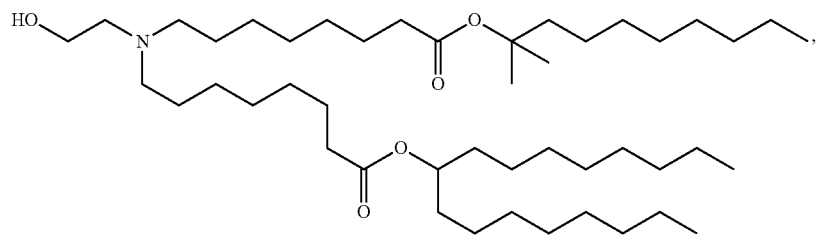
(Compound 86)
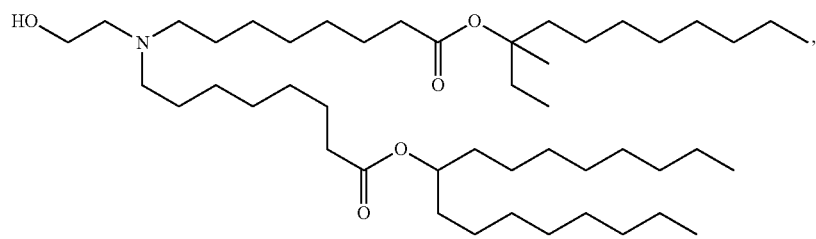
(Compound 87)
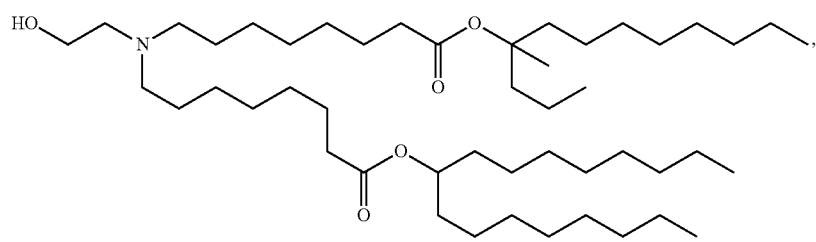
(Compound 88)
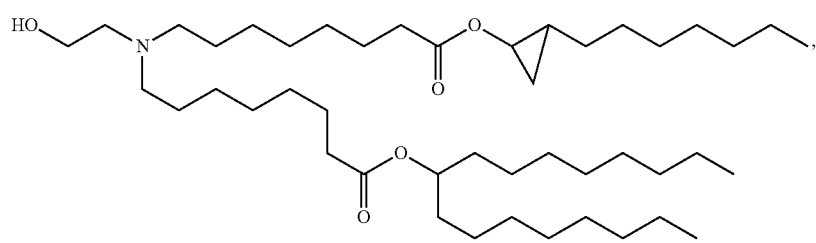
(Compound 89)
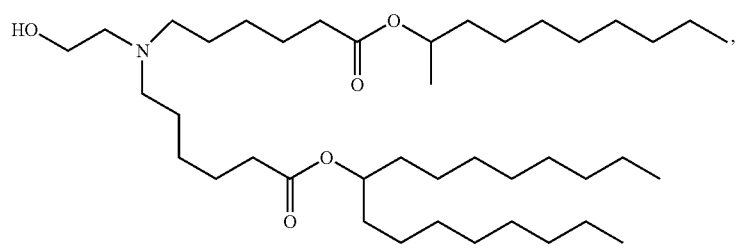

-continued
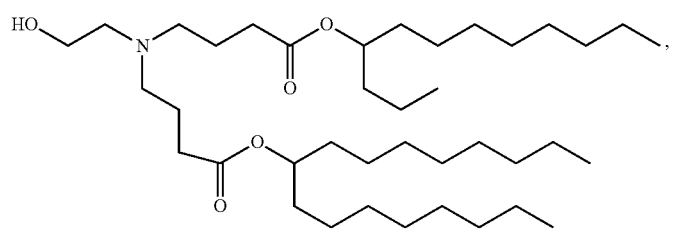
(Compound 90)
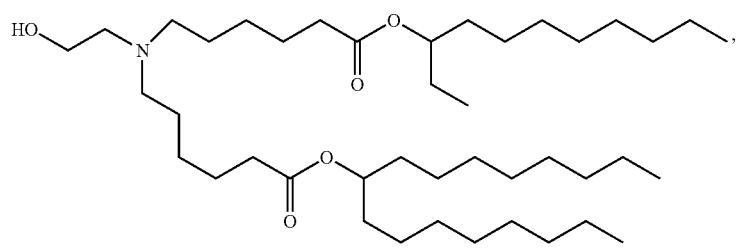
(Compound 91)
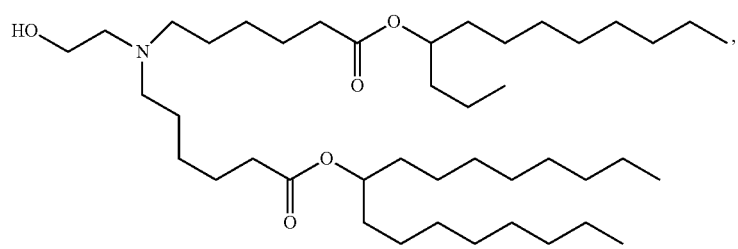
(Compound 92)
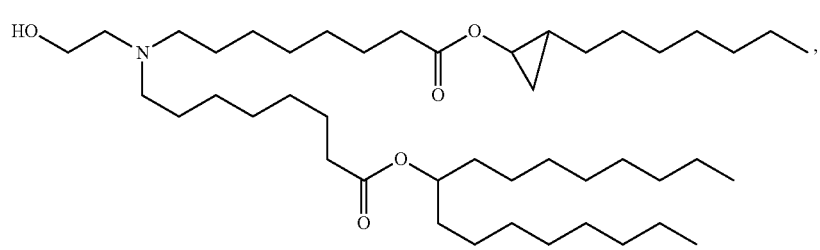
(Compound 93)
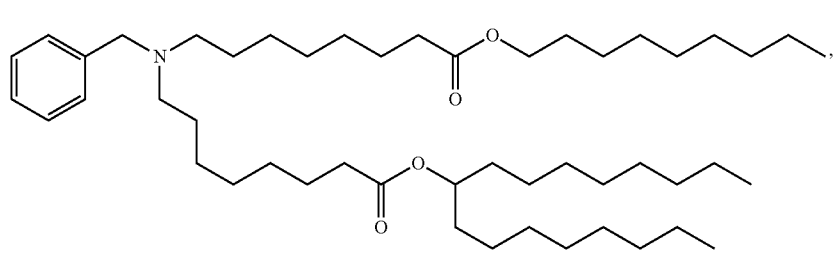
(Compound 94)
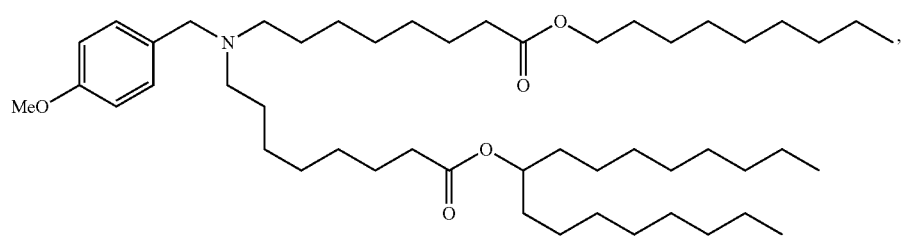
(Compound 95)

(Compound 96)
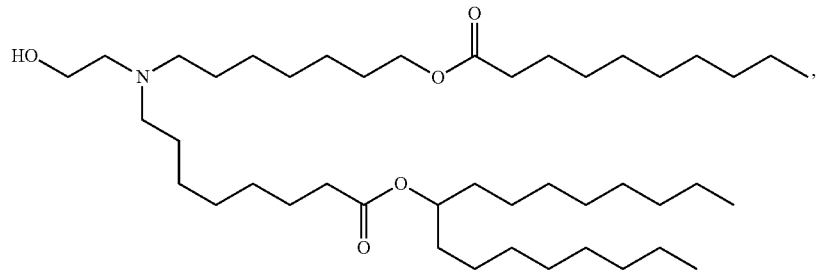
(Compound 97)
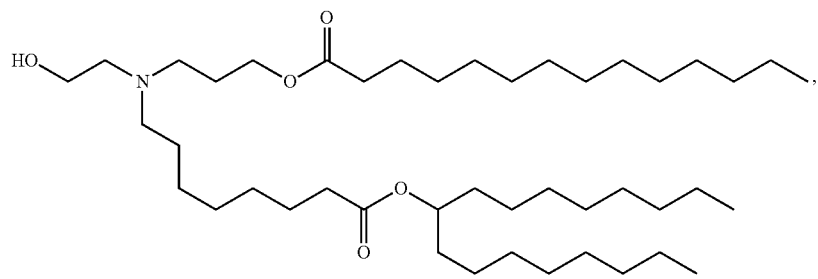
(Compound 98)
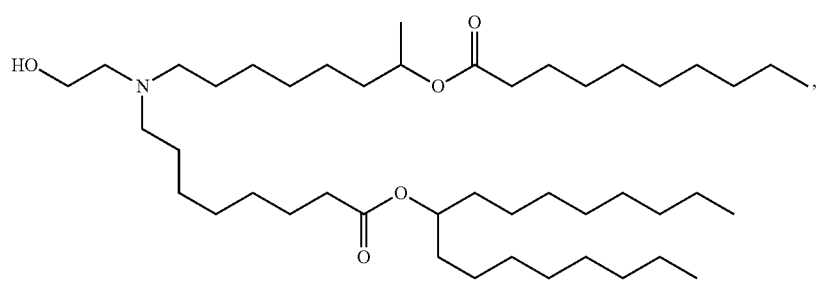
(Compound 99)
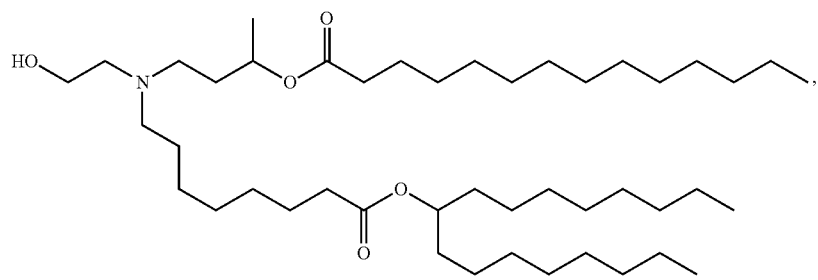
(Compound 100)
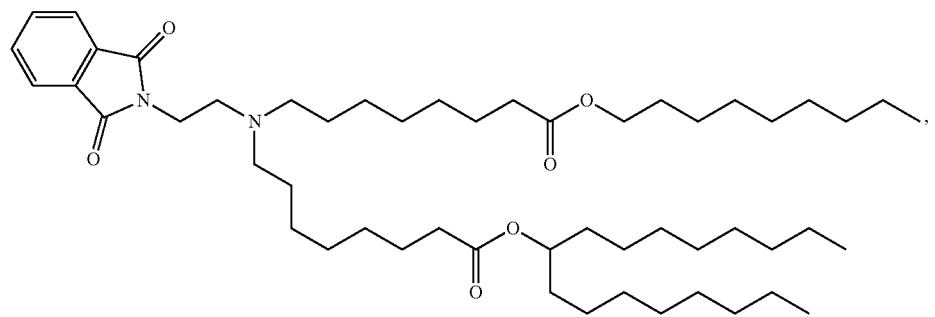

(Compound 101)
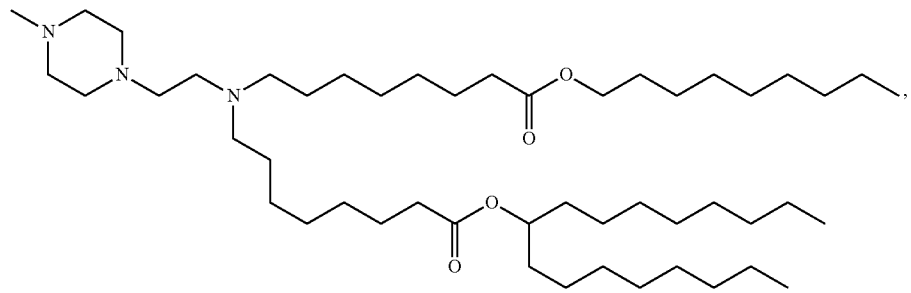
(Compound 102)
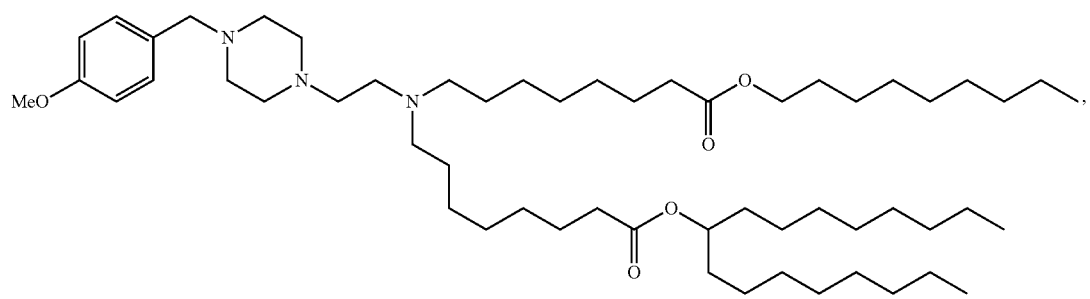
(Compound 103)
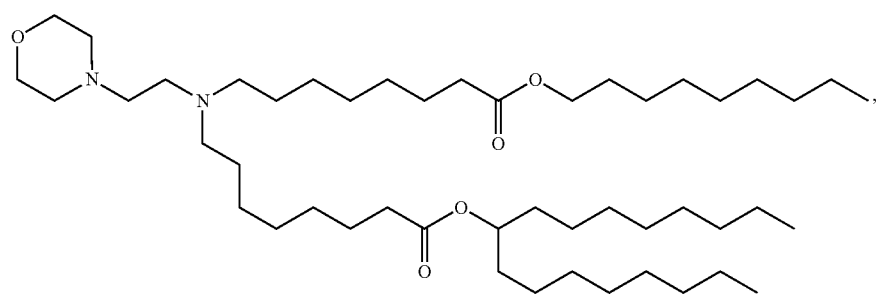
(Compound 104)
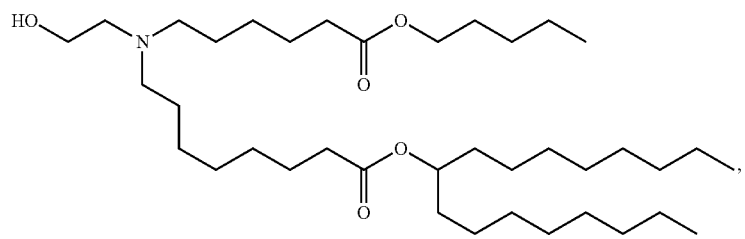
(Compound 105)
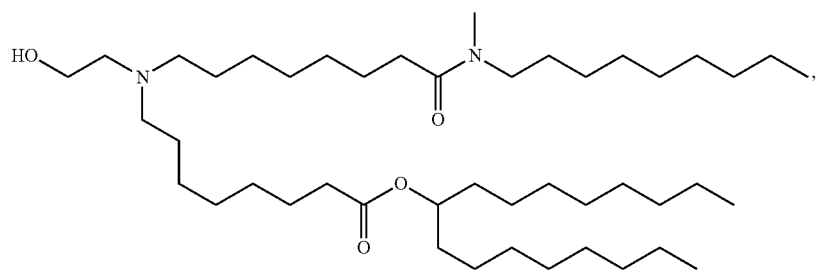

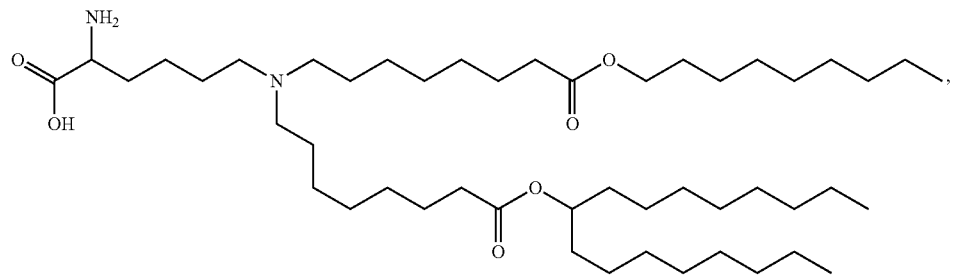
(Compound 106)
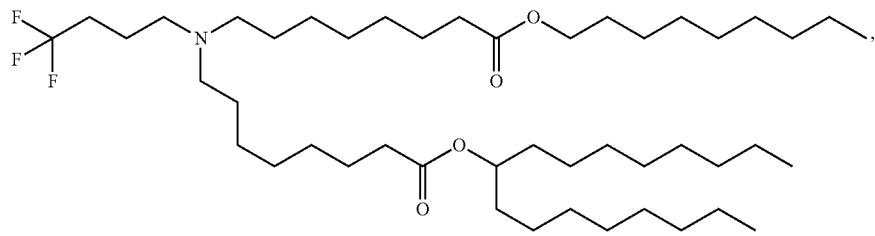
(Compound 107)
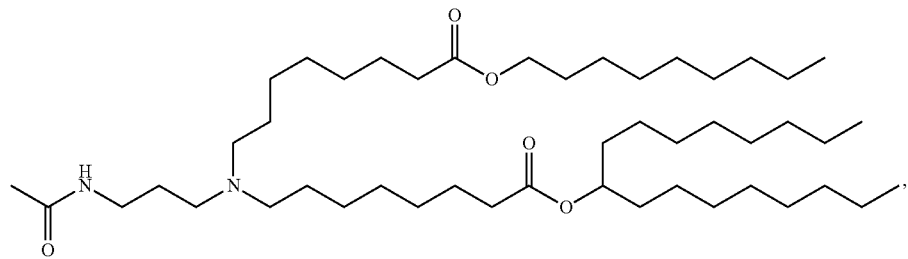
(Compound 108)
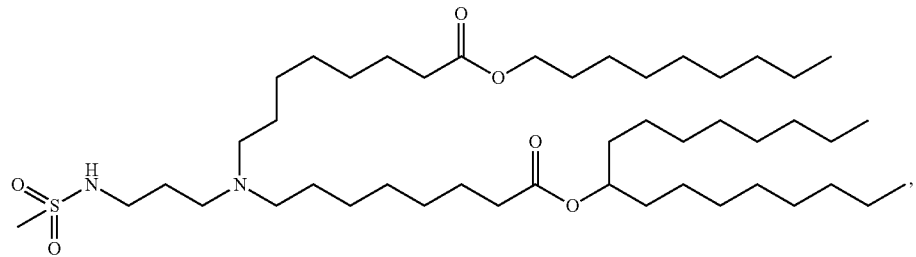
(Compound 109)
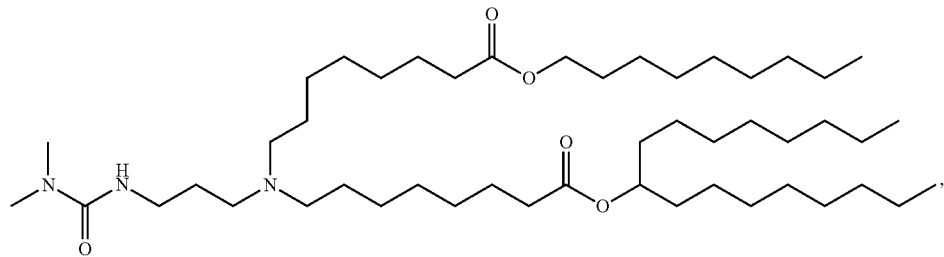
(Compound 110)
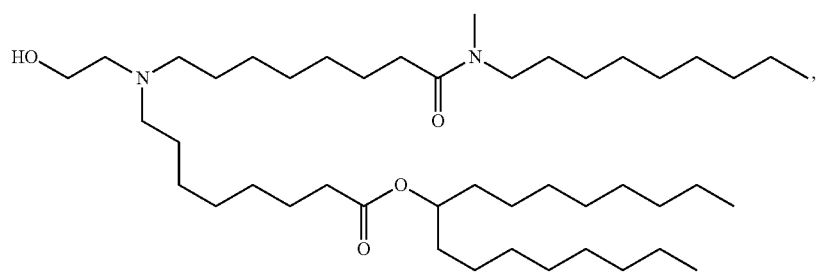
(Compound 105)

(Compound 106)
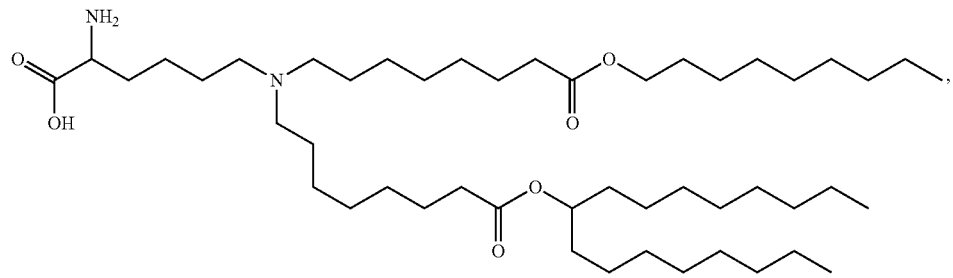
(Compound 107)
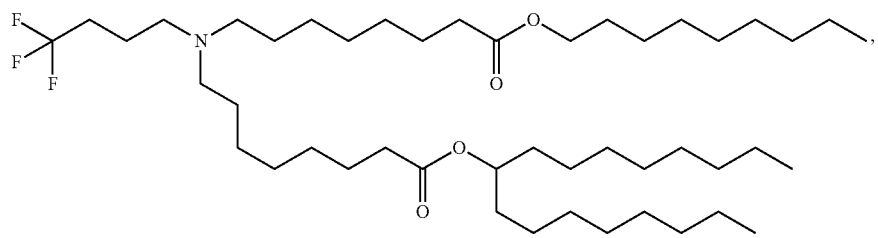
(Compound 108)
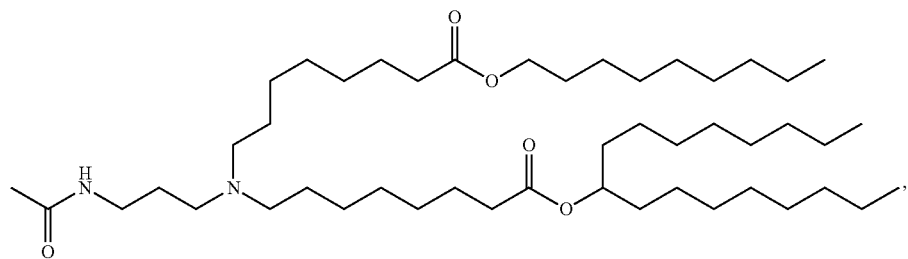
(Compound 109)
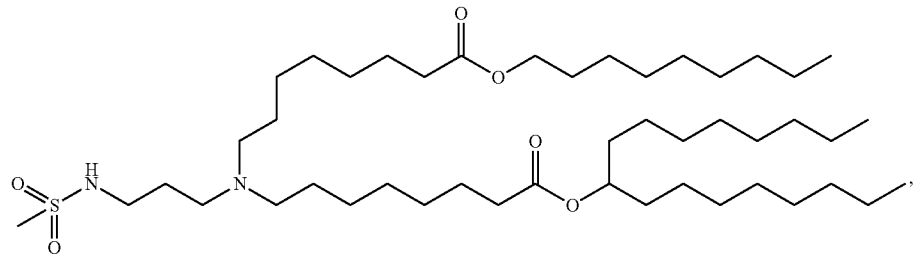
(Compound 110)
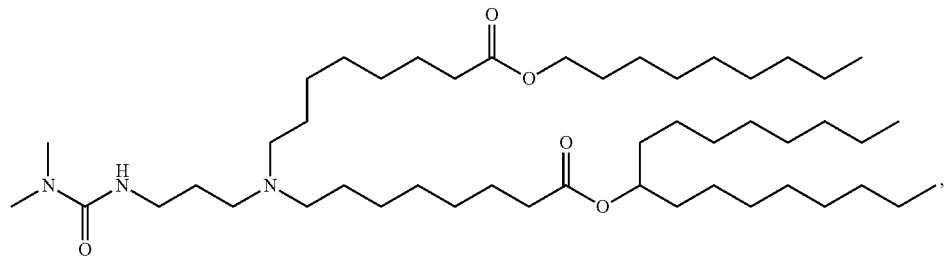
(Compound 111)
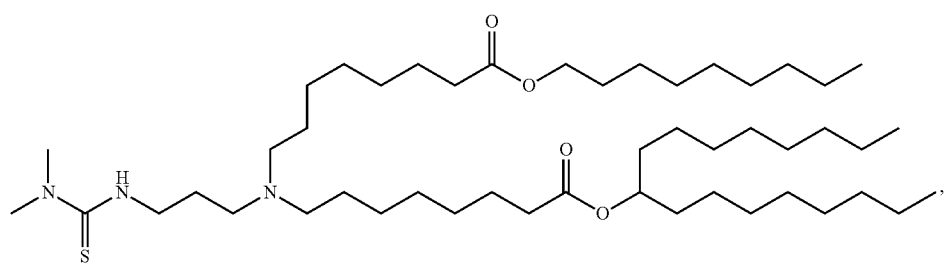

(Compound 112)
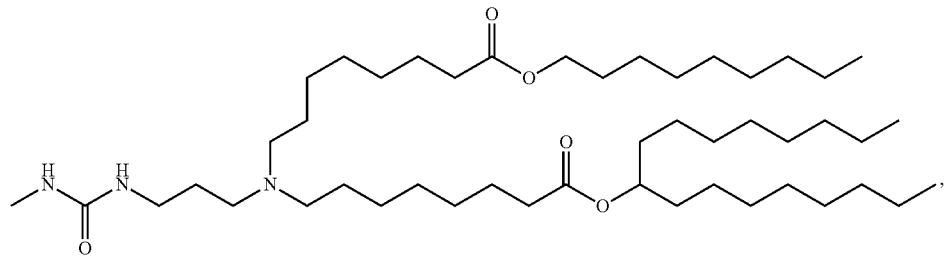
(Compound 113)
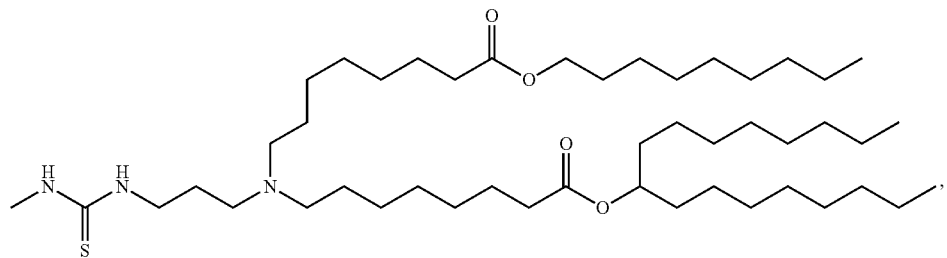
(Compound 114)
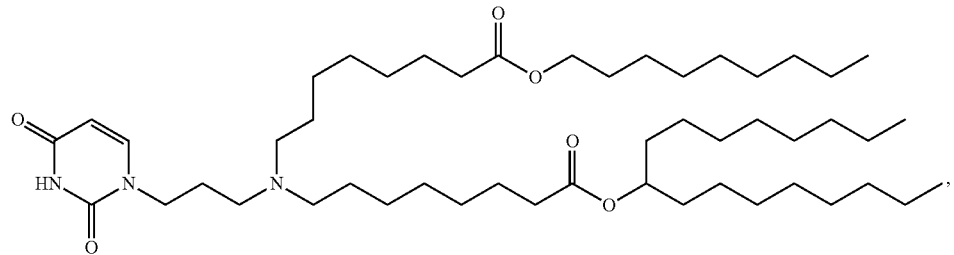
(Compound 115)
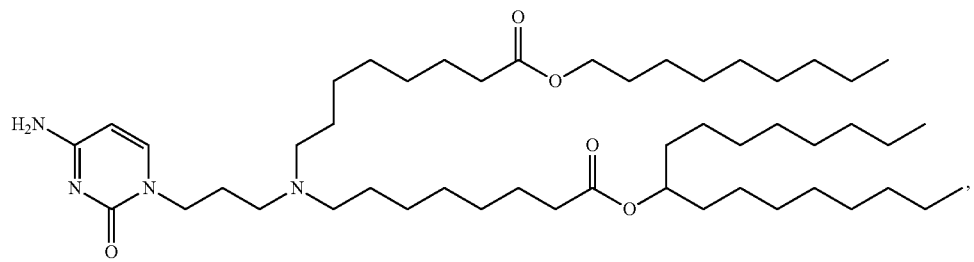
(Compound 116)
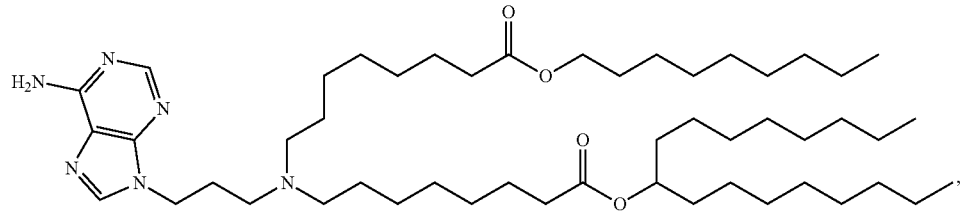
(Compound 117)
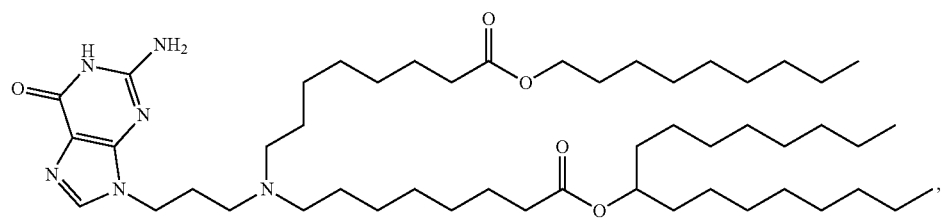

-continued
(Compound 118)
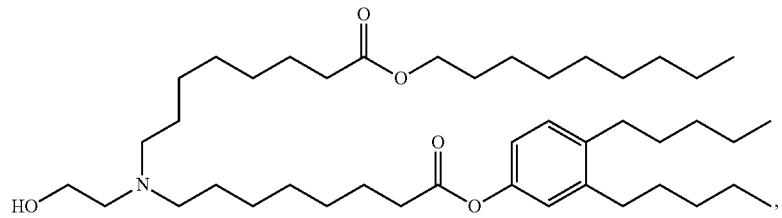
(Compound 119)
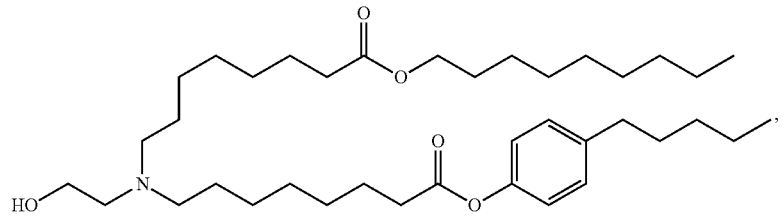
(Compound 120)
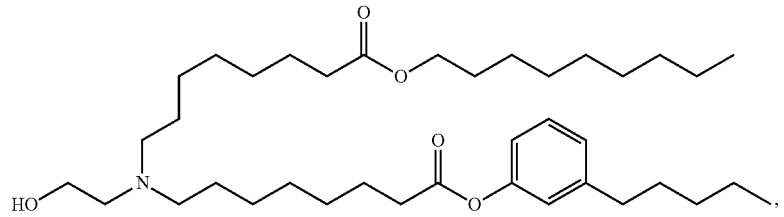
(Compound 121)
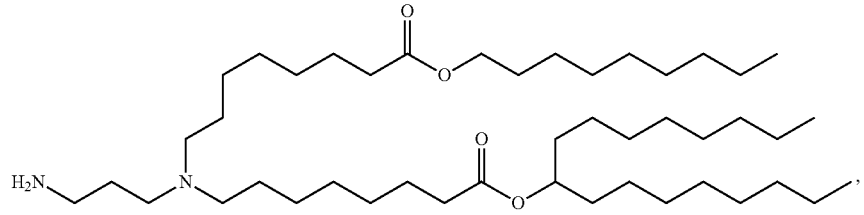
(Compound 122)
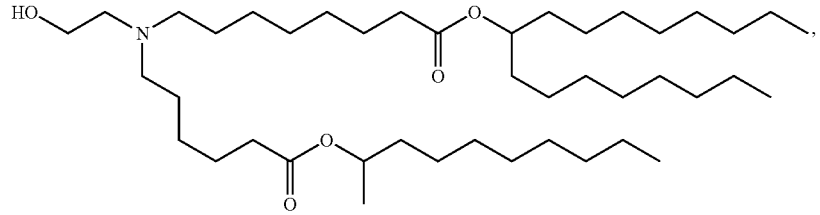
(Compound 123)
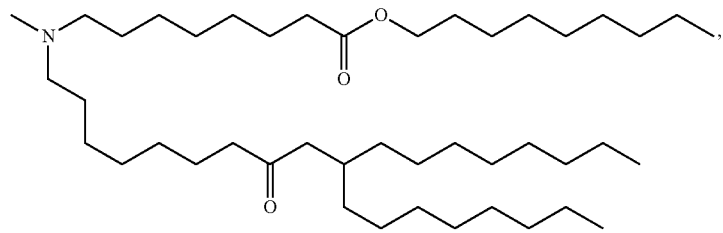
(Compound 124)
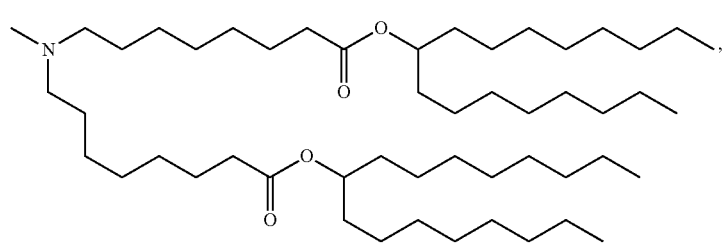

(Compound 125)
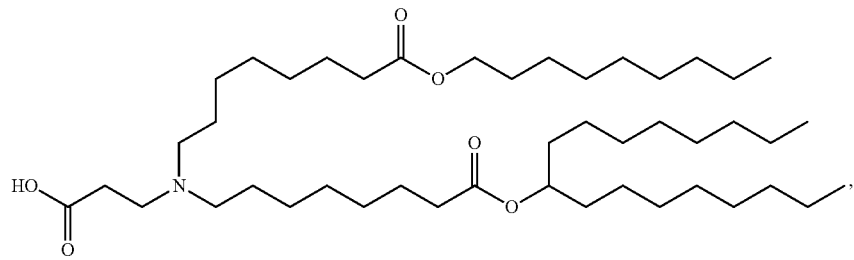
(Compound 126)
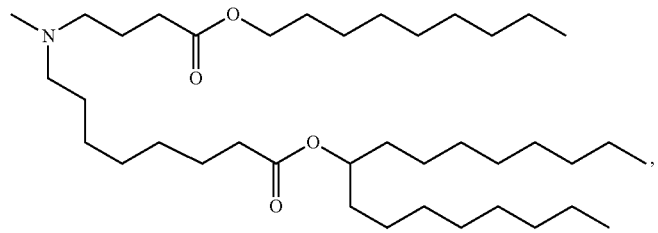
(Compound 127)
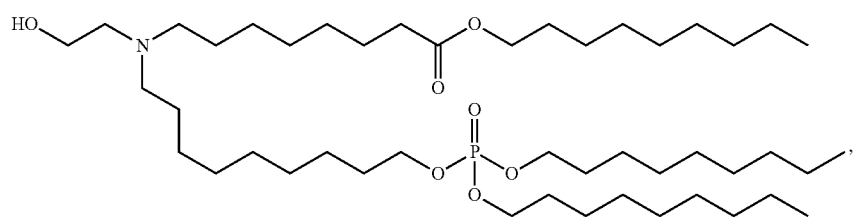
(Compound 128)
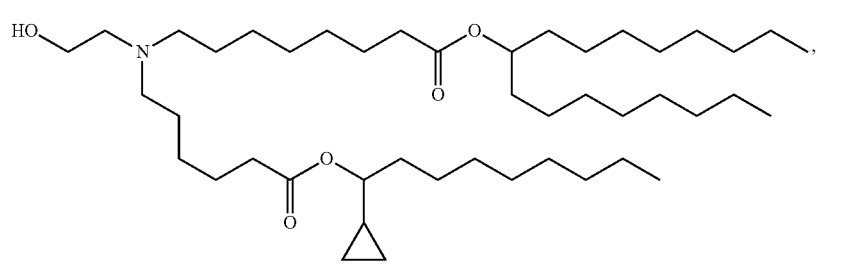
(Compound 129)
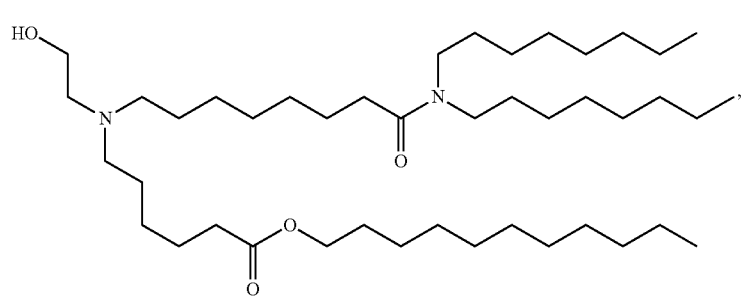
(Compound 130)
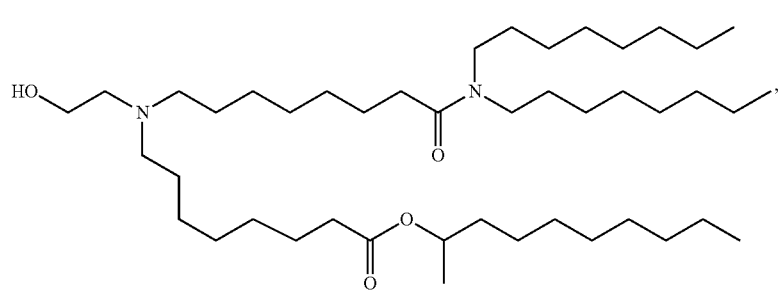

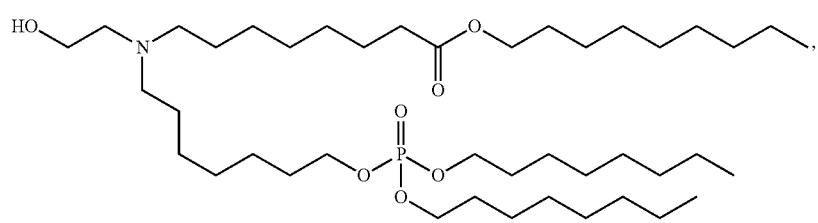
(Compound 131)
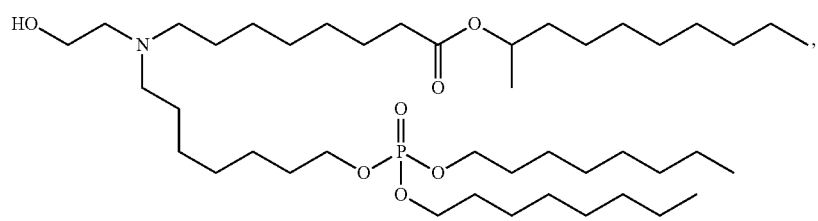
(Compound 132)
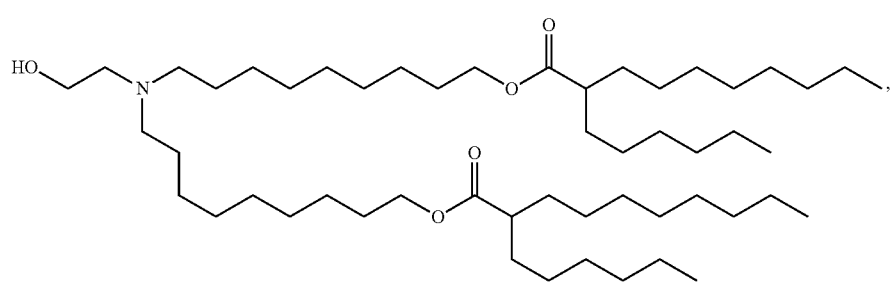
(Compound 133)
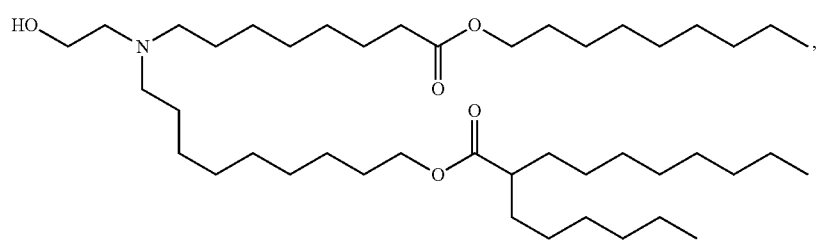
(Compound 134)
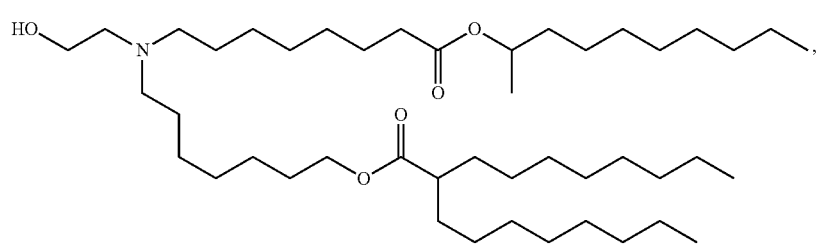
(Compound 135)
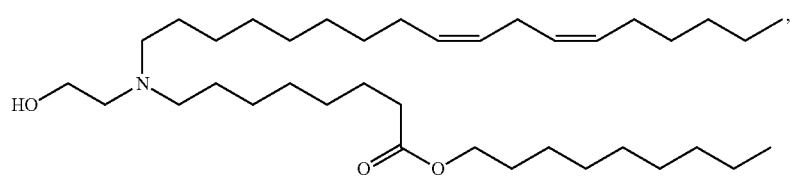
(Compound 136)
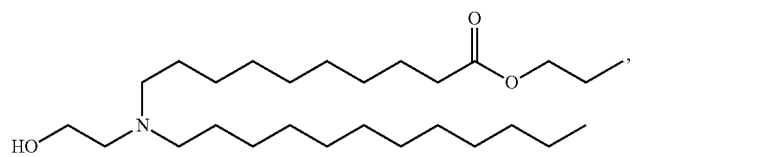
(Compound 137)

-continued
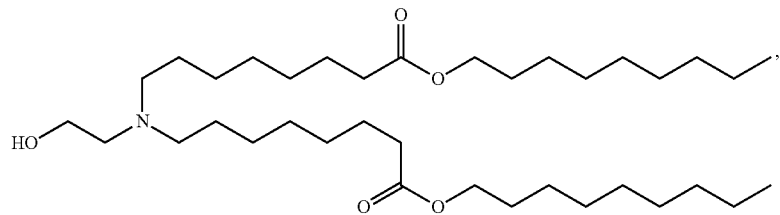
(Compound 138)
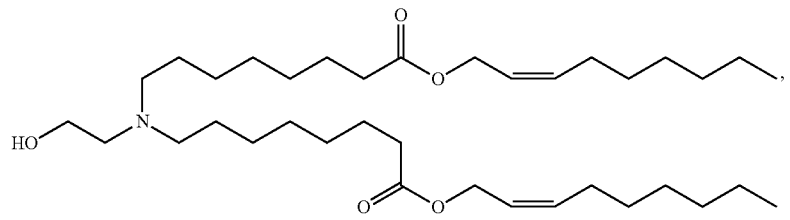
(Compound 139)
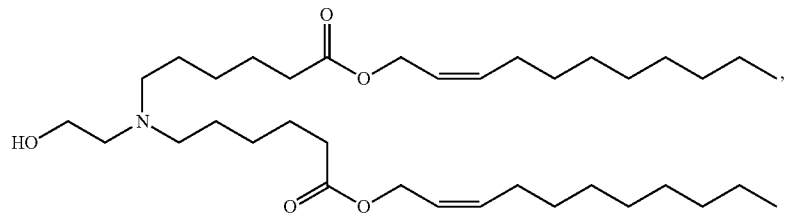
(Compound 140)
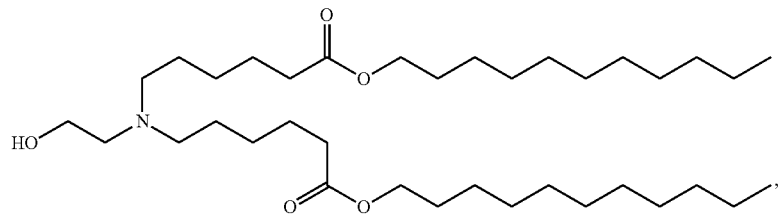
(Compound 141)
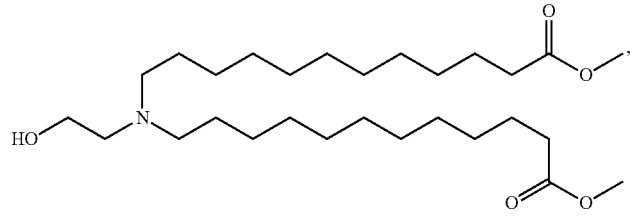
(Compound 142)
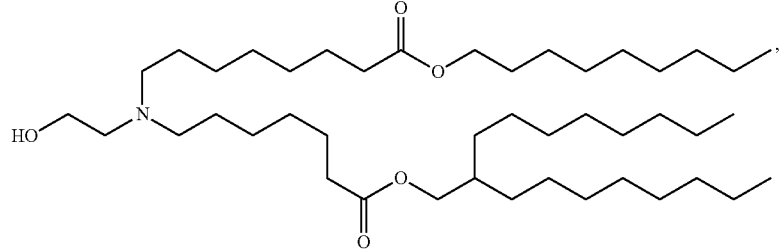
(Compound 143)

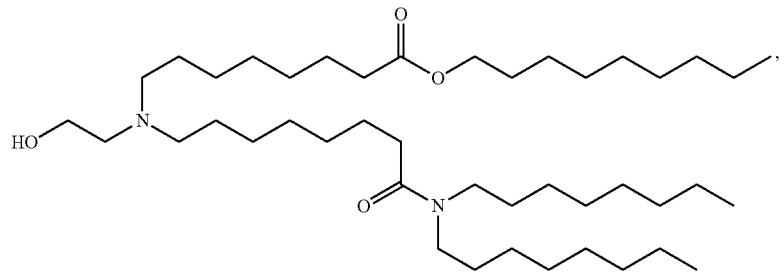
(Compound 144)
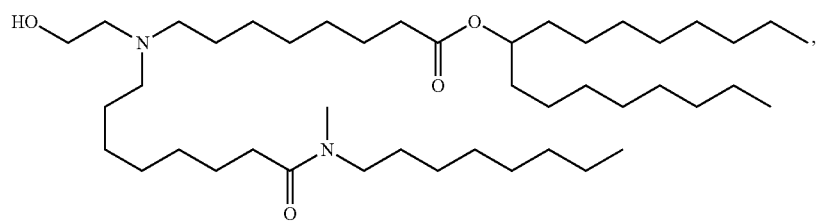
(Compound 145)
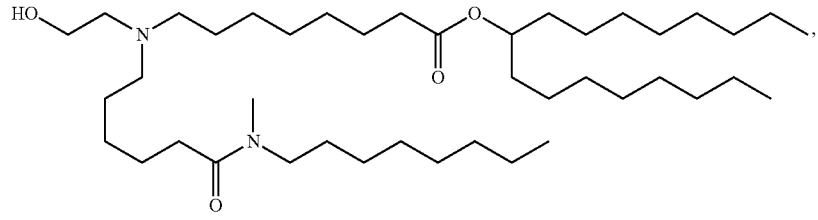
(Compound 146)
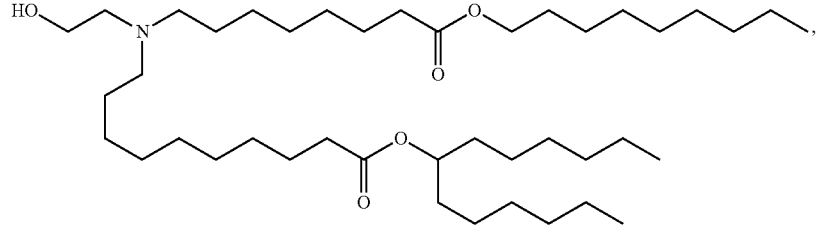
(Compound 147)
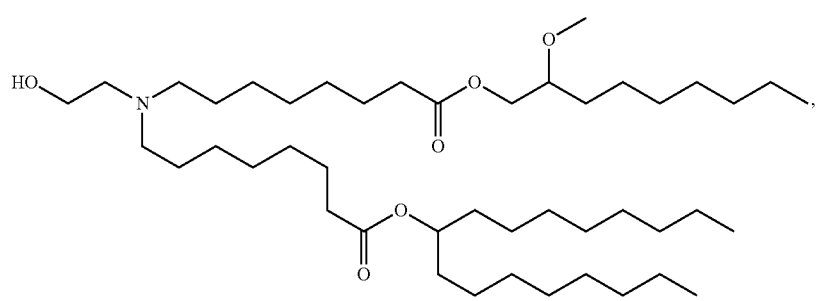
(Compound 148)
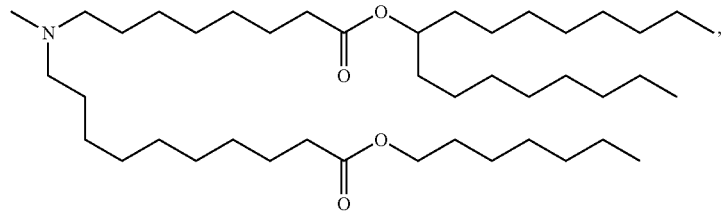
(Compound 149)

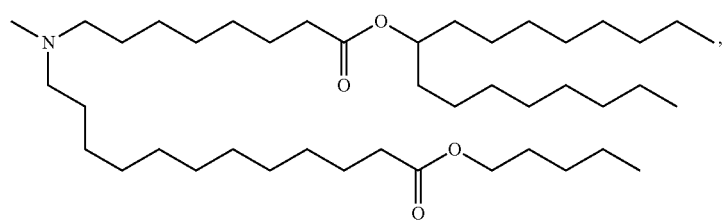
(Compound 150)
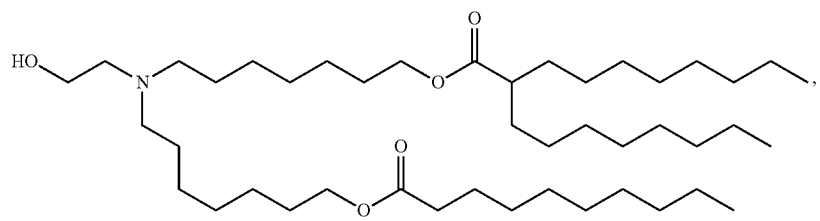
(Compound 151)
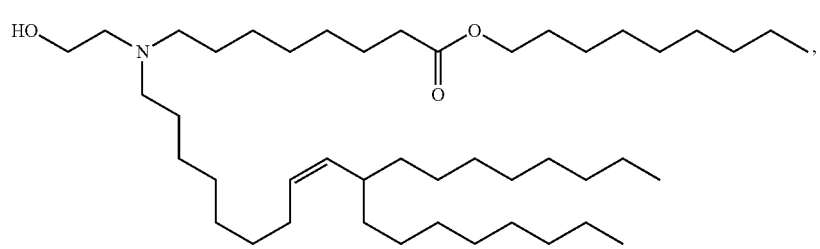
(Compound 152)
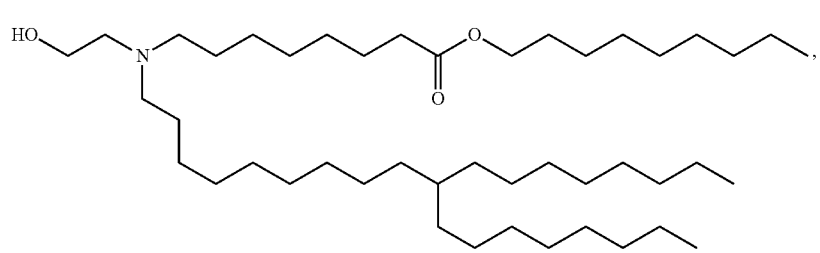
(Compound 153)
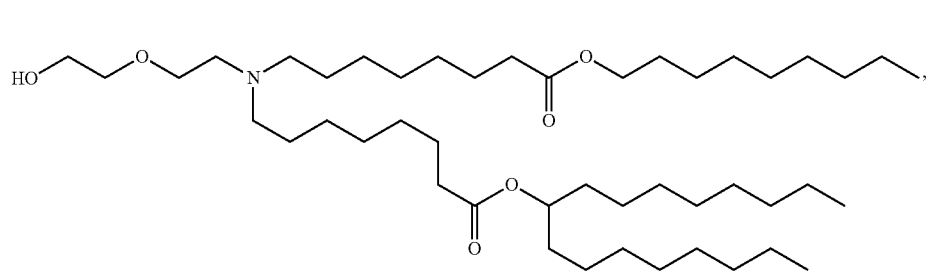
(Compound 154)
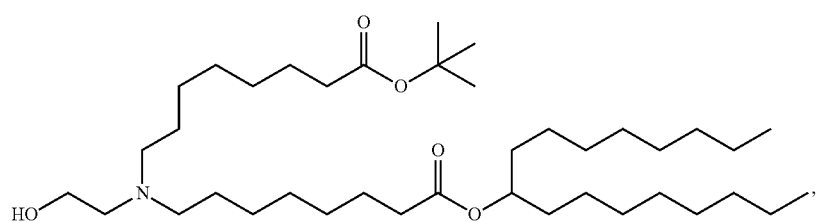
(Compound 155)

-continued
(Compound 156)
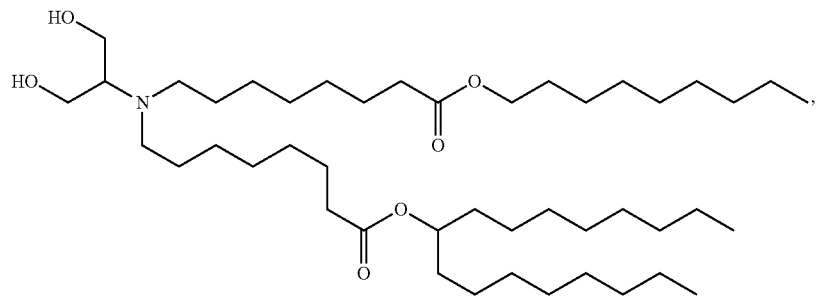
(Compound 157)
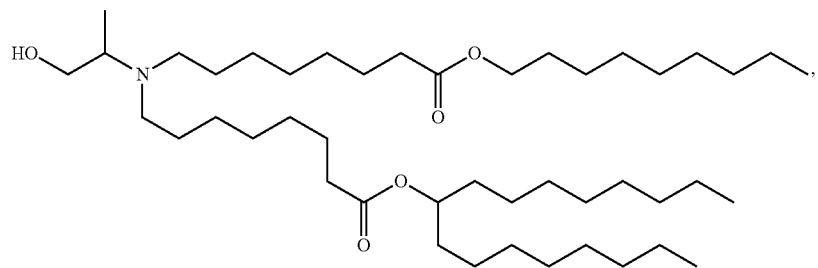
(Compound 158)
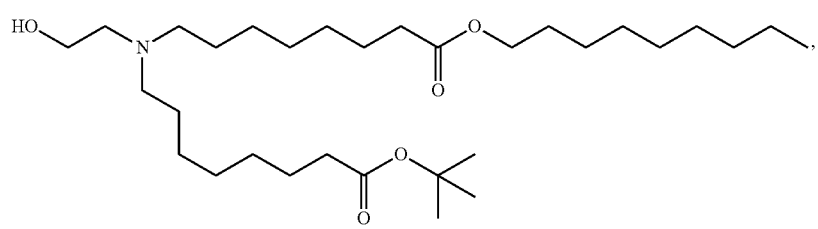
(Compound 159)
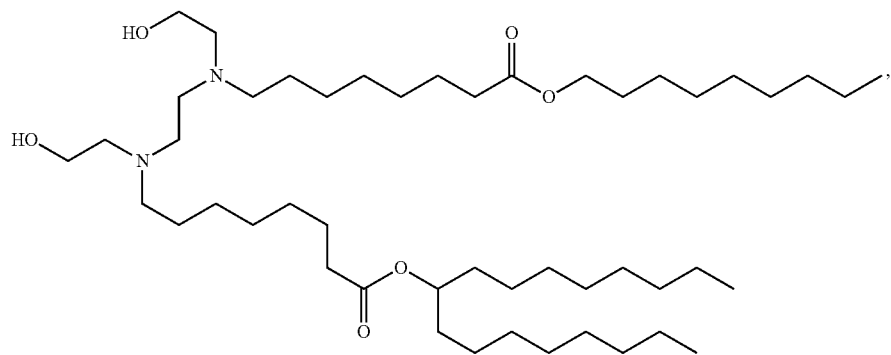

-continued
(Compound 160)
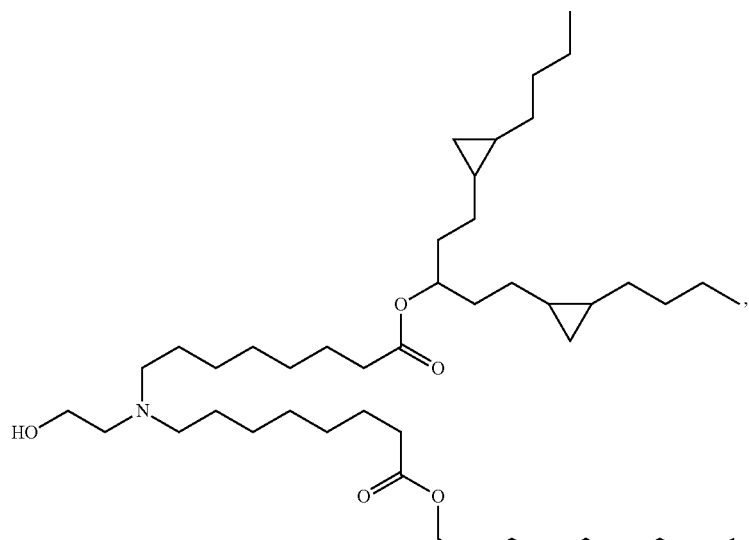
(Compound 161)
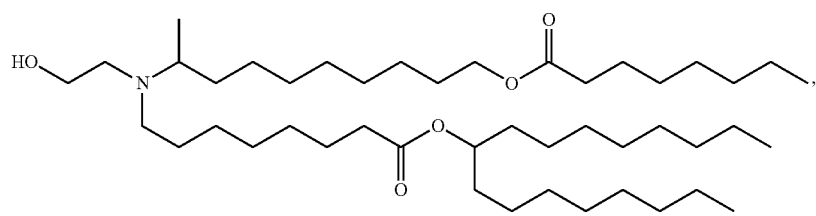
(Compound 162)
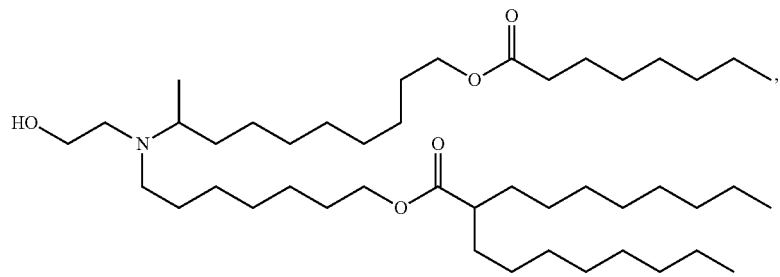
(Compound 163)
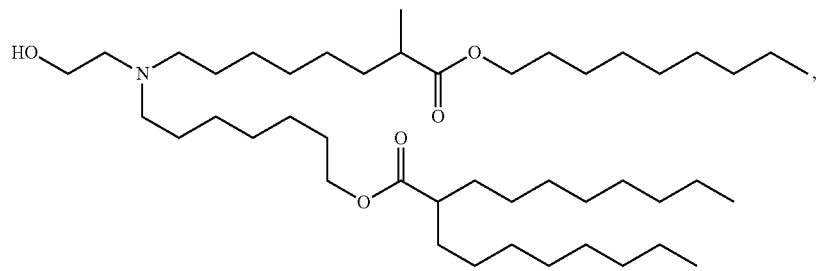
(Compound 164)
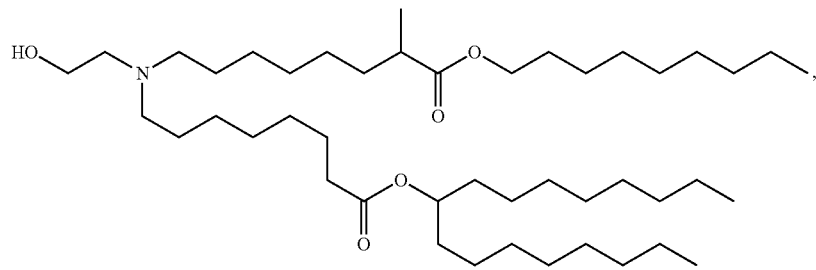

-continued
(Compound 165)
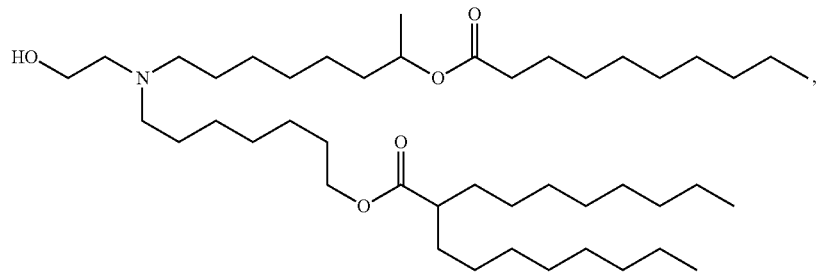
(Compound 166)
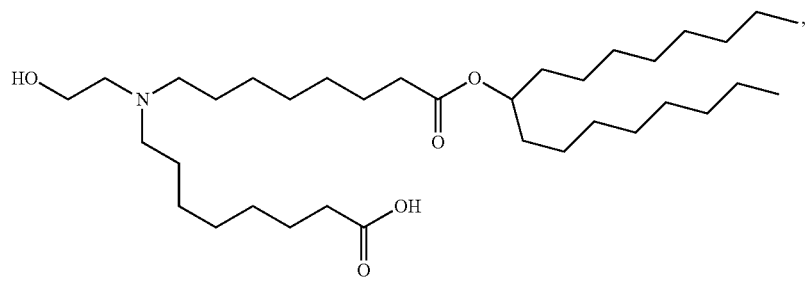
(Compound 167)
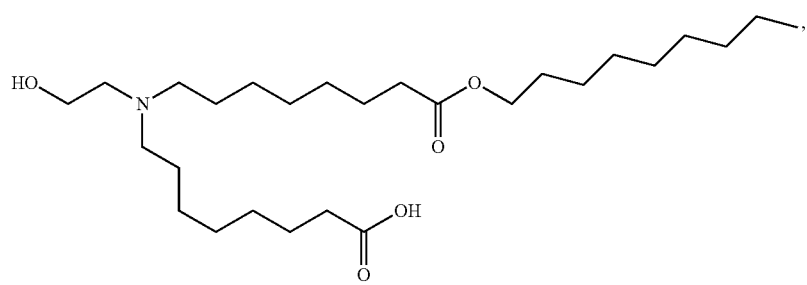
(Compound 168)
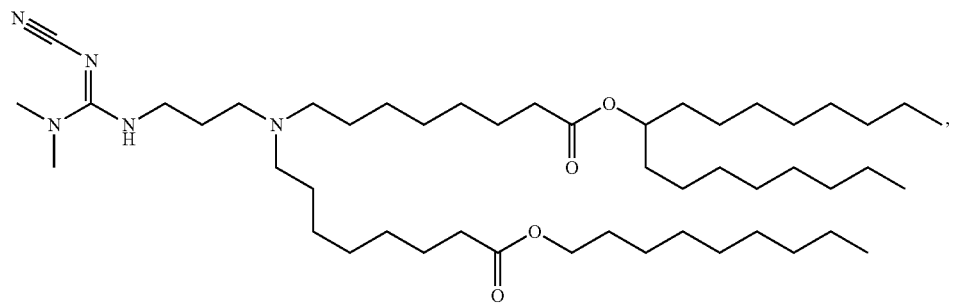
(Compound 169)
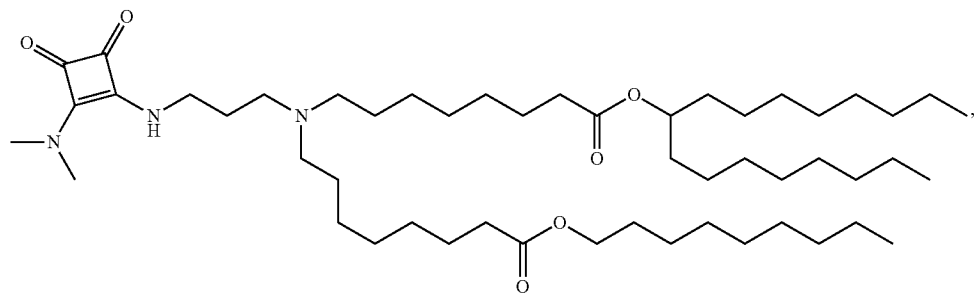

-continued
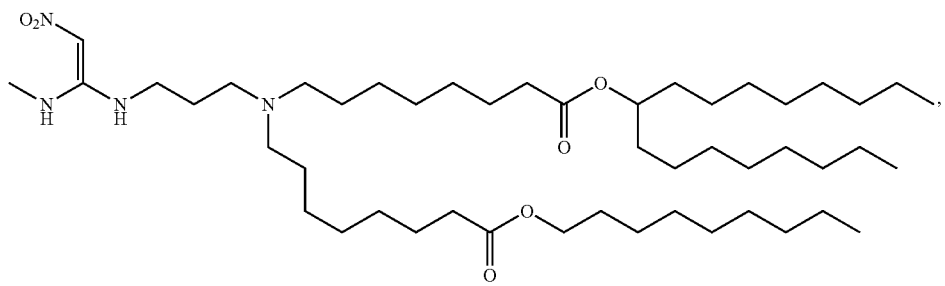
(Compound 170)
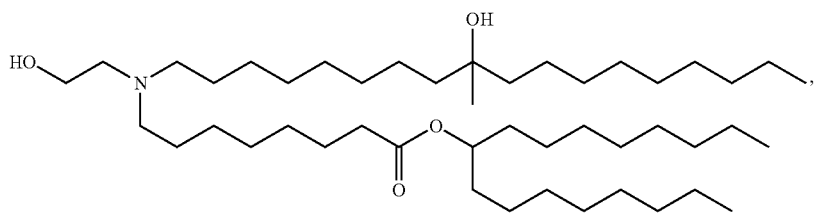
(Compound 171)
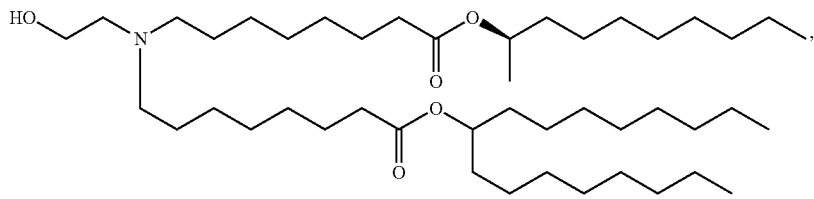
(Compound 172)
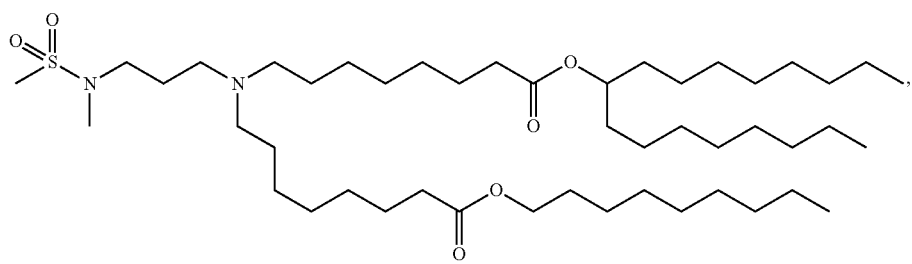
(Compound 173)
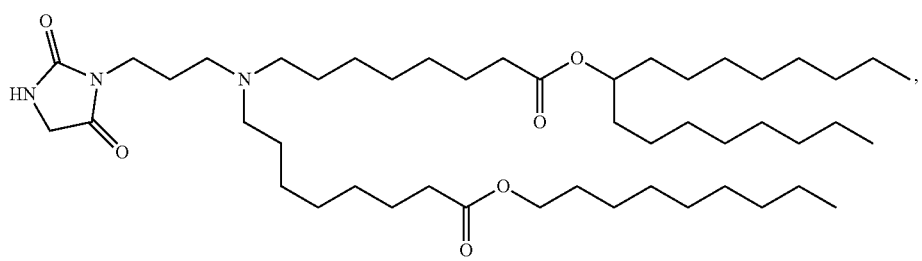
(Compound 174)
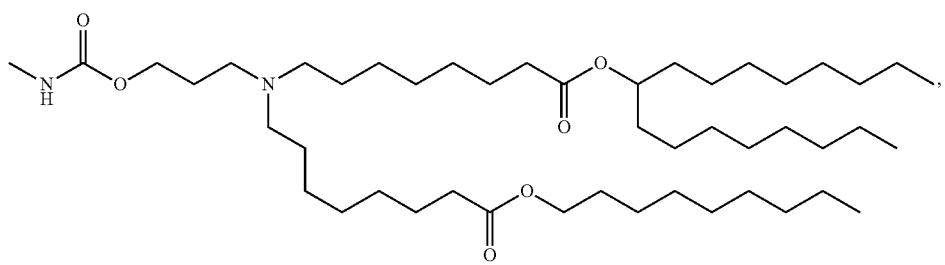
(Compound 175)

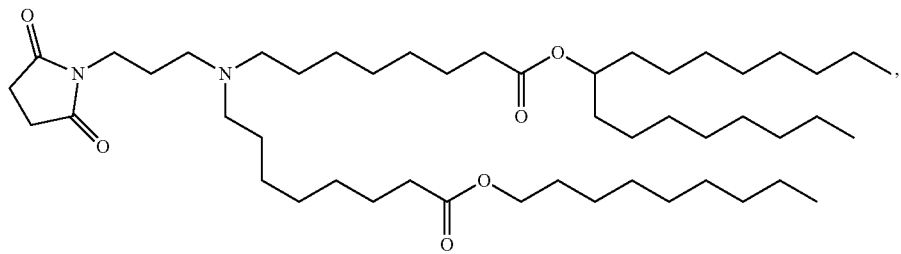
(Compound 176)
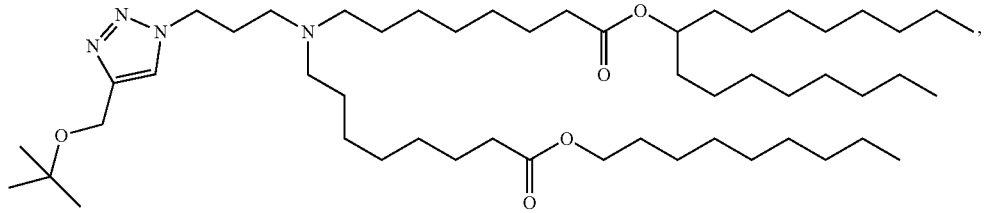
(Compound 177)
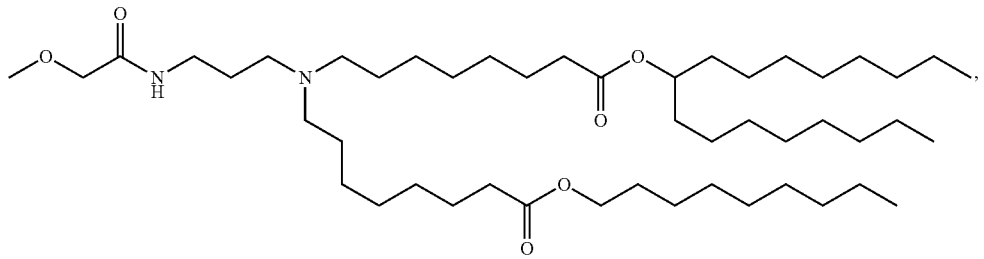
(Compound 178)
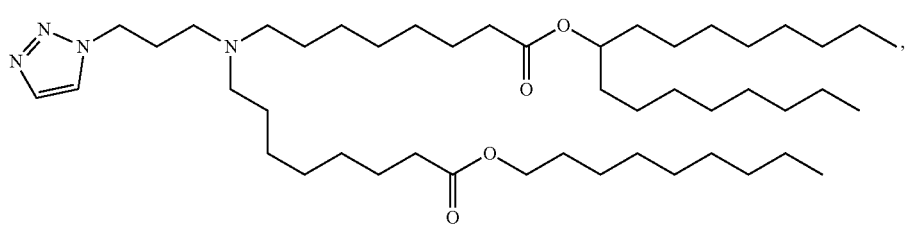
(Compound 179)
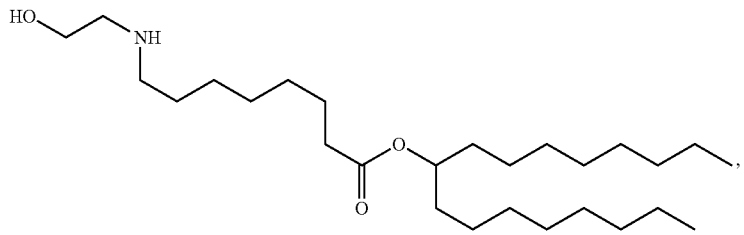
(Compound 180)
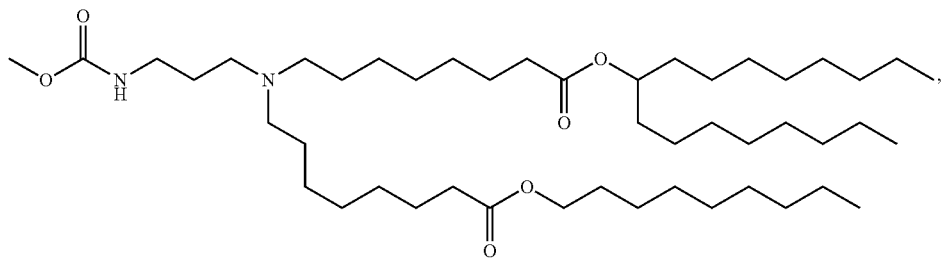
(Compound 181)

-continued
(Compound 182)
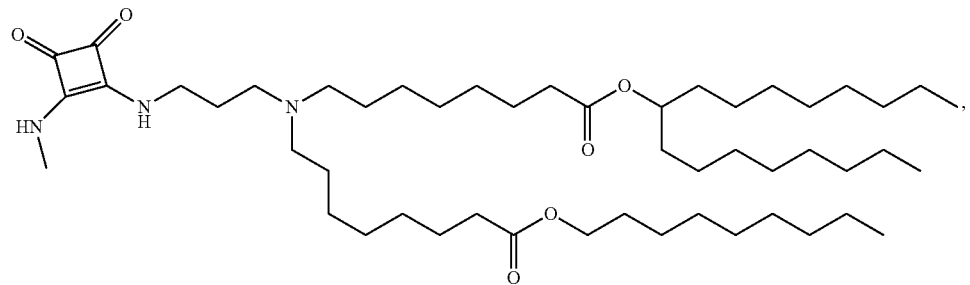
(Compound 183)
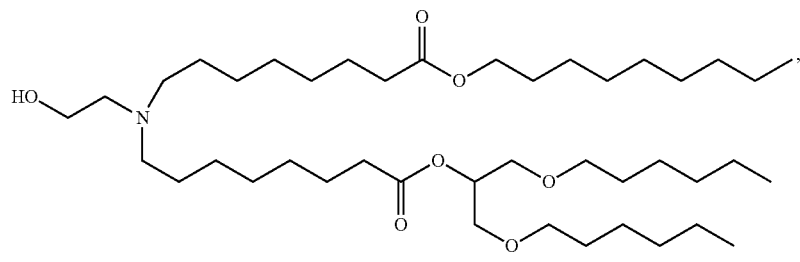
(Compound 184)
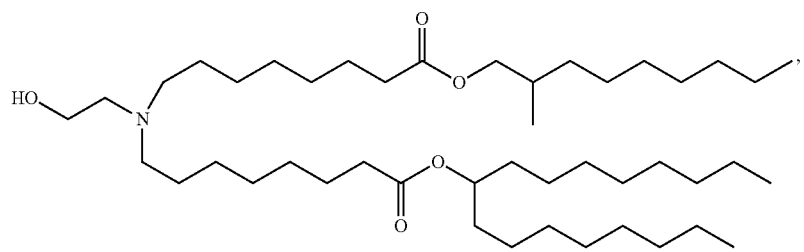
(Compound 185)
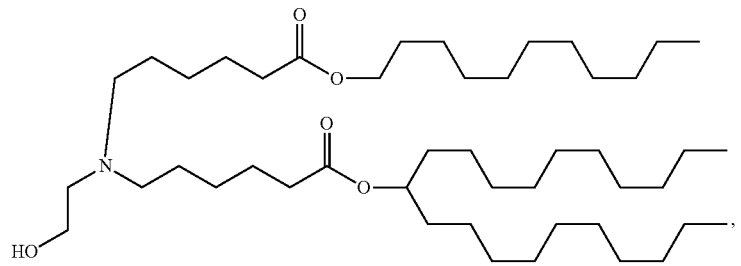
(Compound 186)
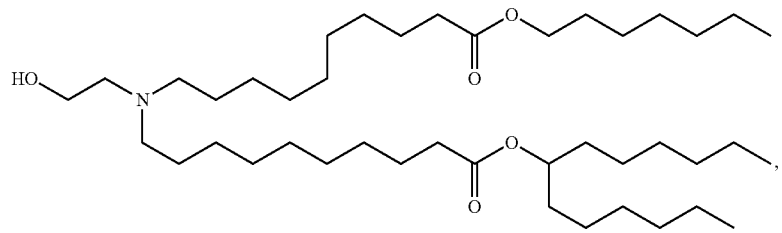
(Compound 187)
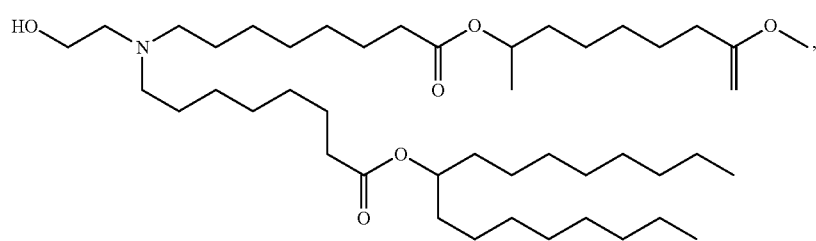

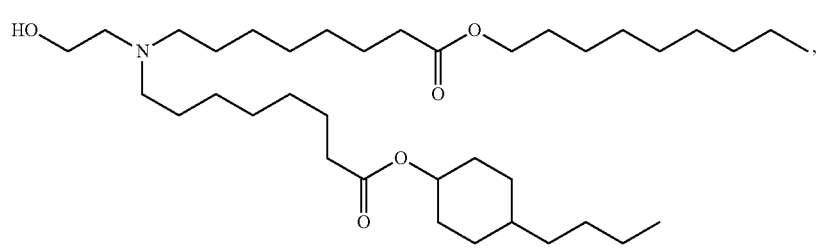
(Compound 188)
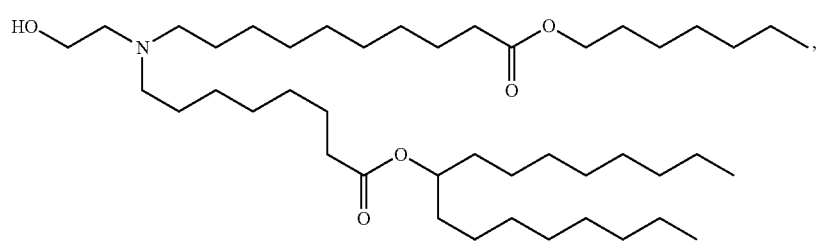
(Compound 189)
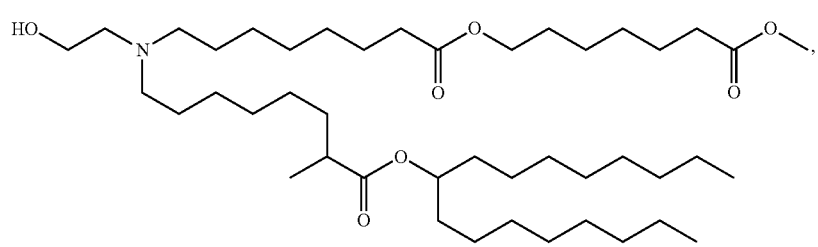
(Compound 190)
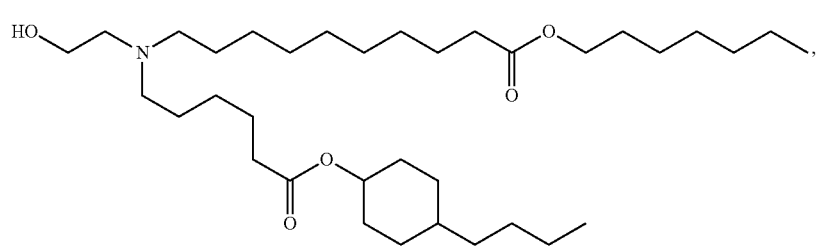
(Compound 191)
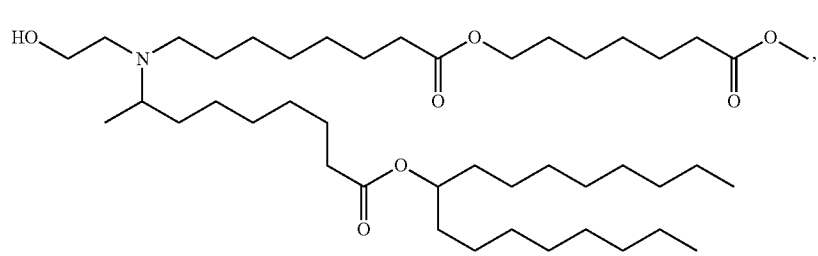
(Compound 192)
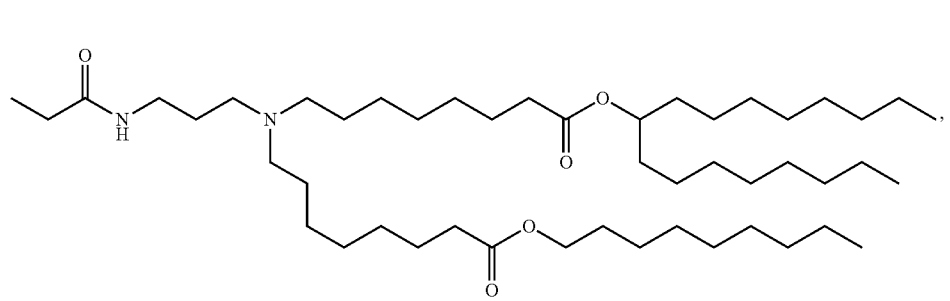
(Compound 193)

-continued
(Compound 194)
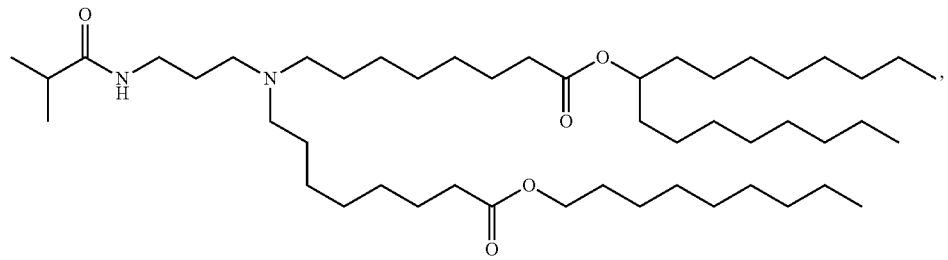
(Compound 195)
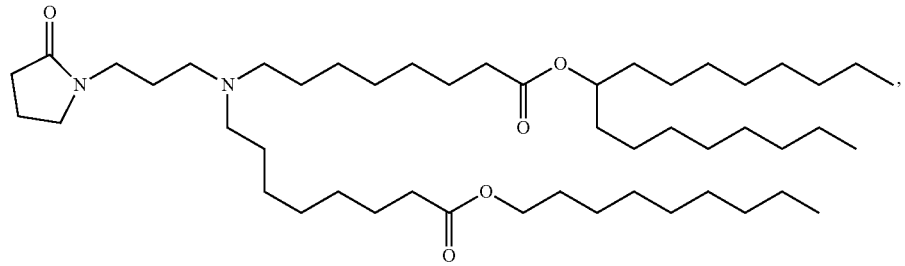
(Compound 196)
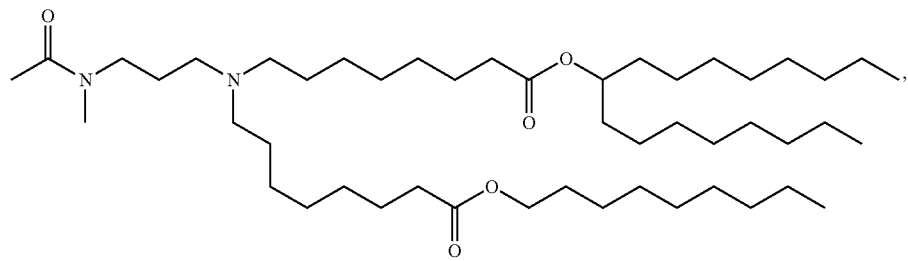
(Compound 197)
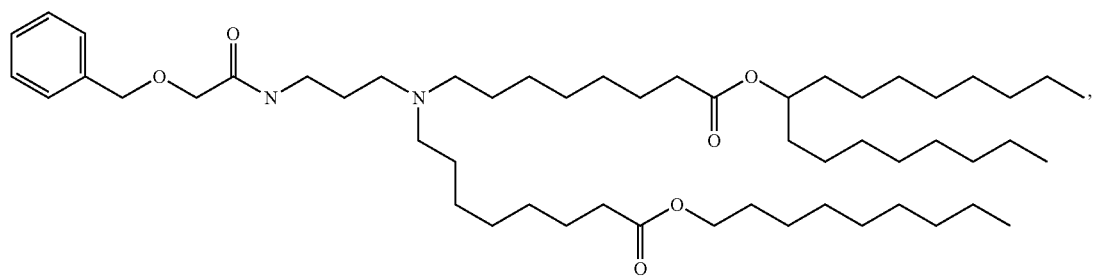
(Compound 198)
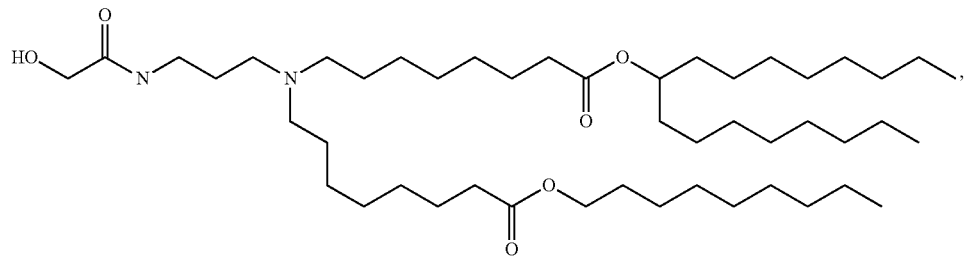
(Compound 199)
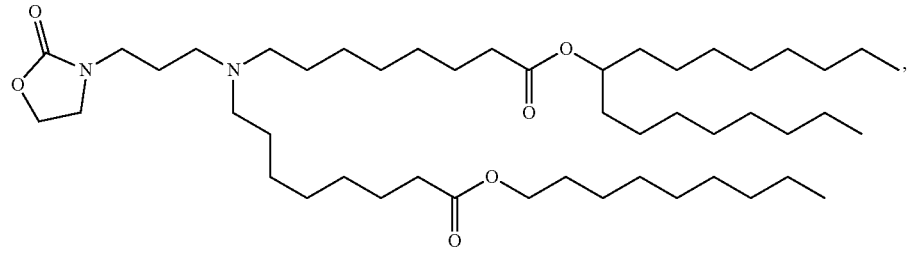

(Compound 200)
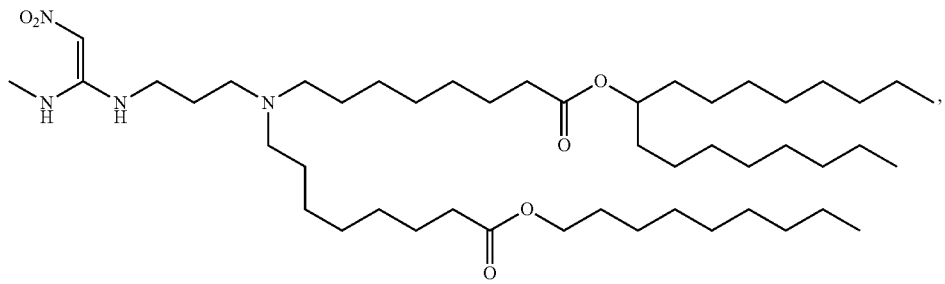
(Compound 201)
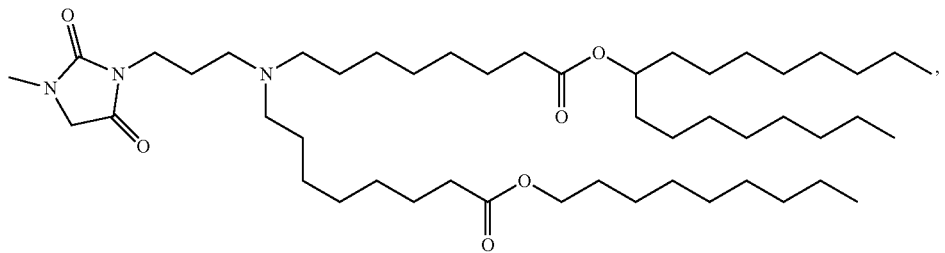
(Compound 202)
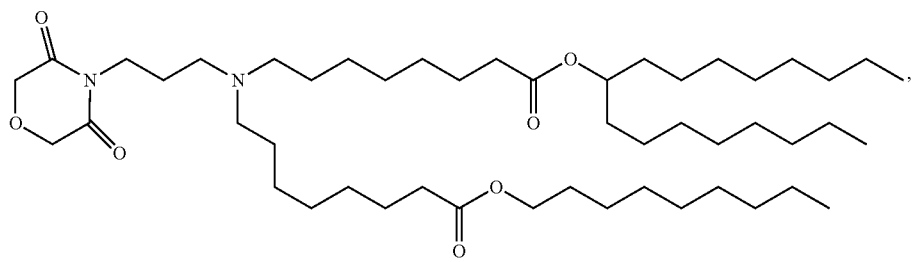
(Compound 203)
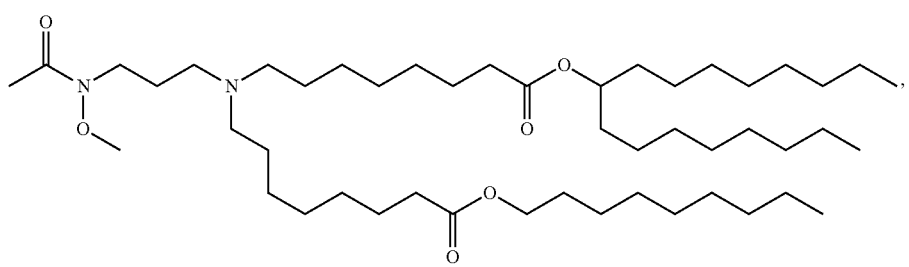
(Compound 204)
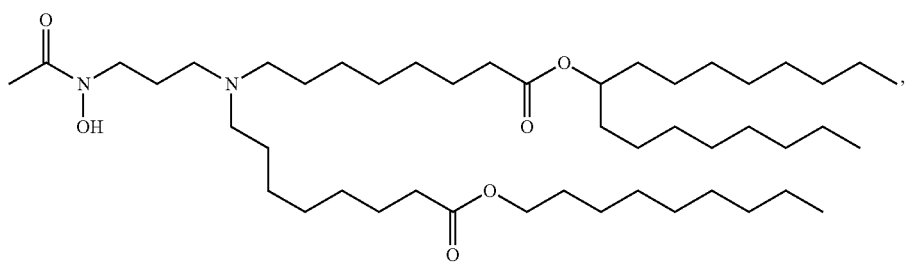
(Compound 205)
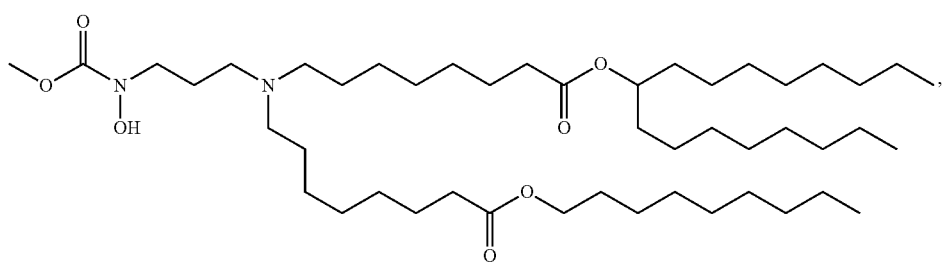

(Compound 206)
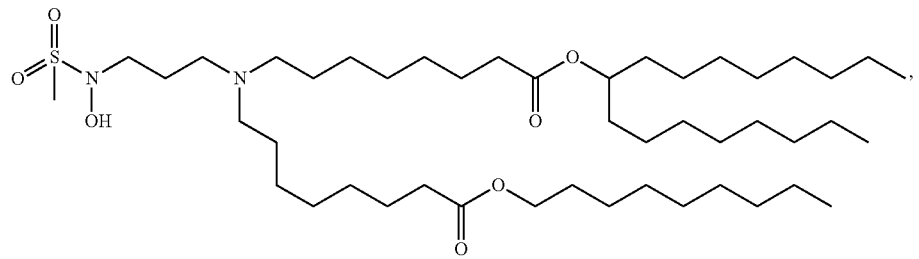
(Compound 207)
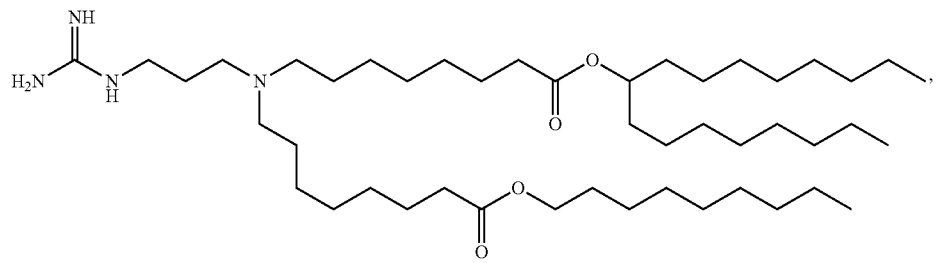
(Compound 208)
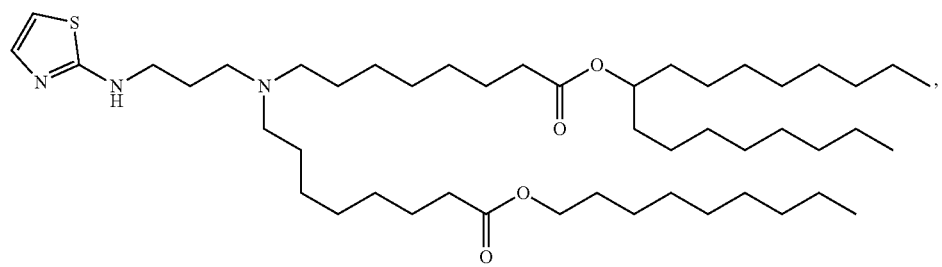
(Compound 209)
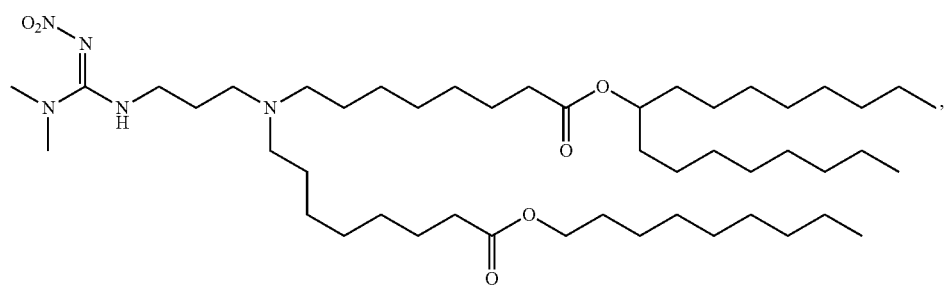
(Compound 210)
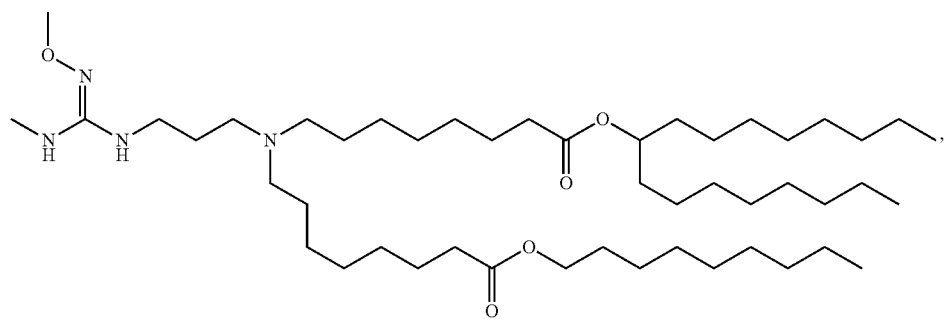

(Compound 211)
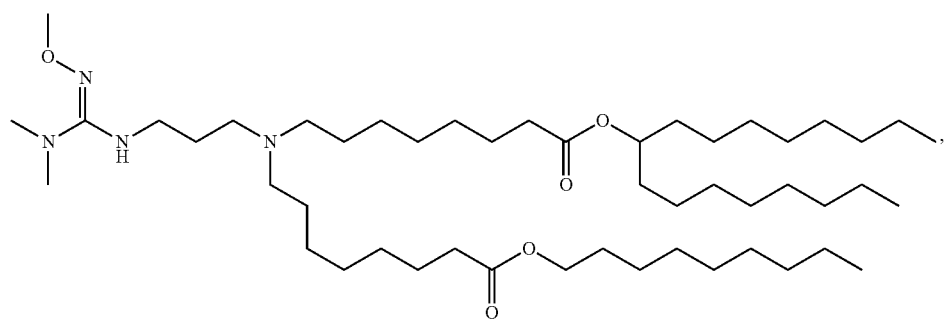
(Compound 212)
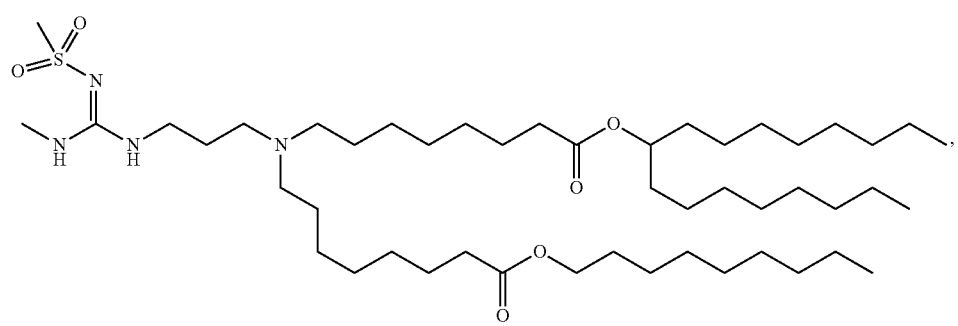
(Compound 213)
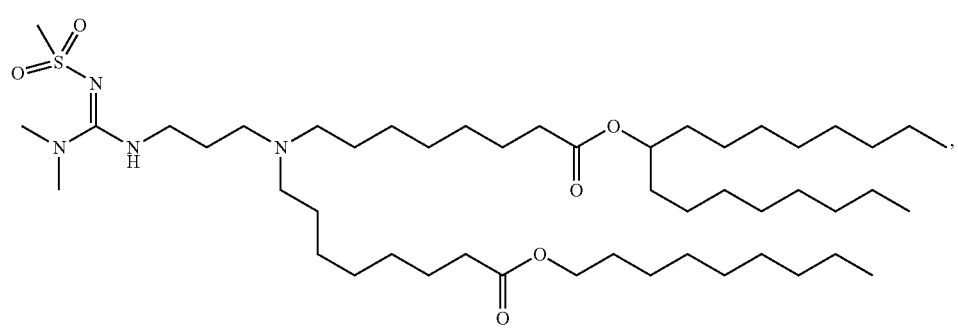
(Compound 214)
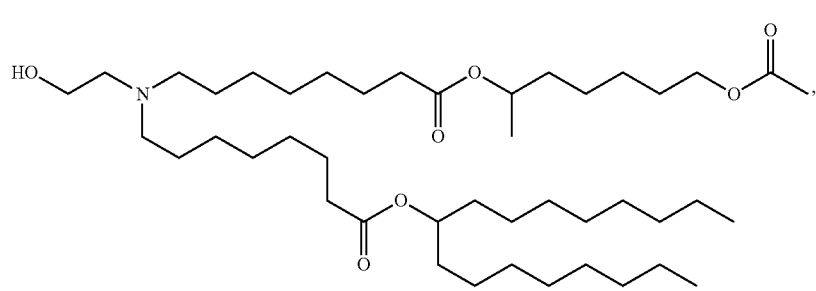
(Compound 215)
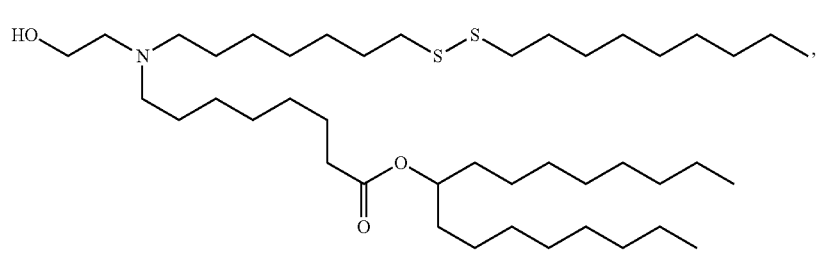

-continued
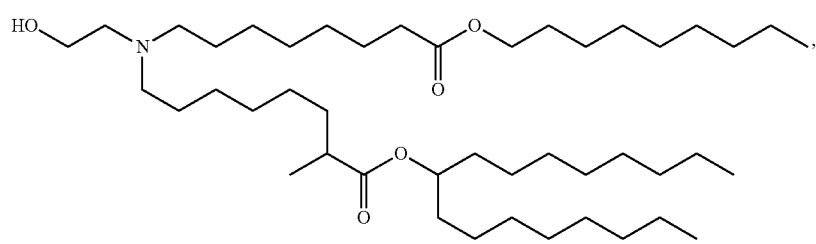
(Compound 216)
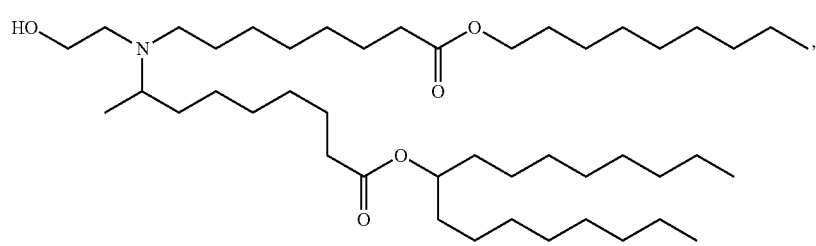
(Compound 217)
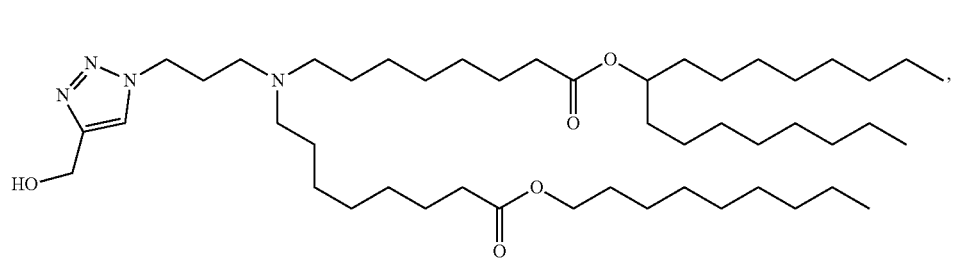
(Compound 218)
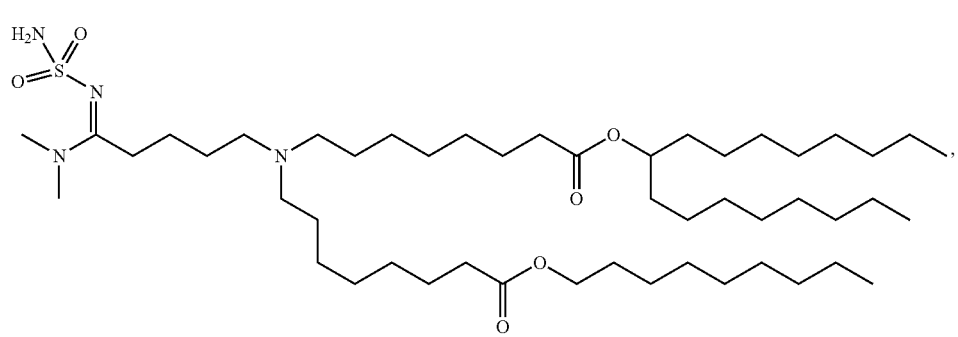
(Compound 219)
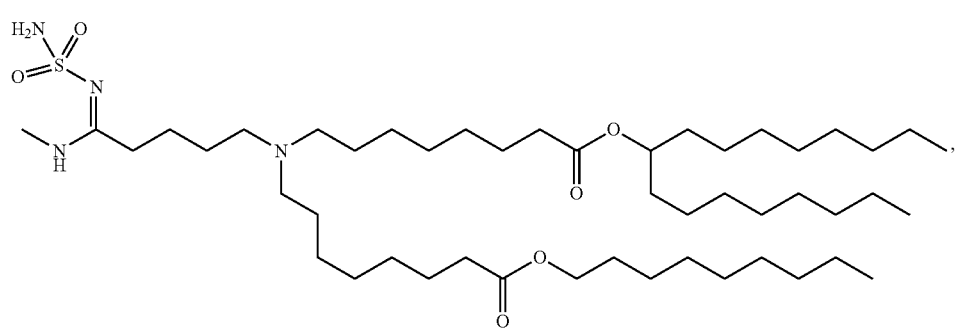
(Compound 220)

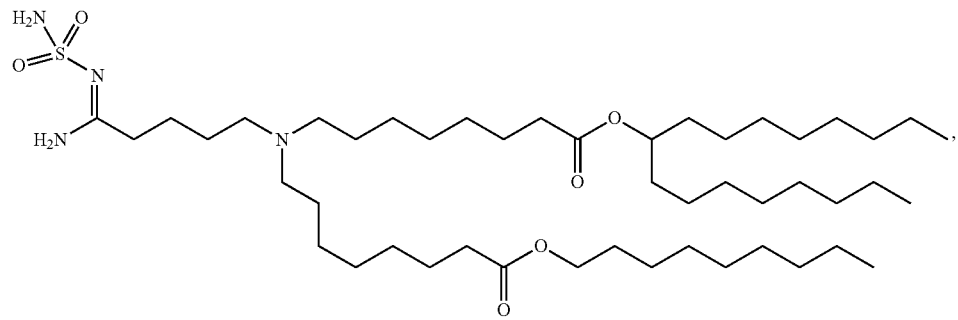
(Compound 221)
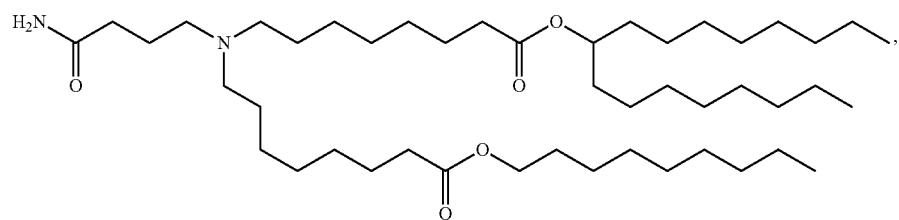
(Compound 222)
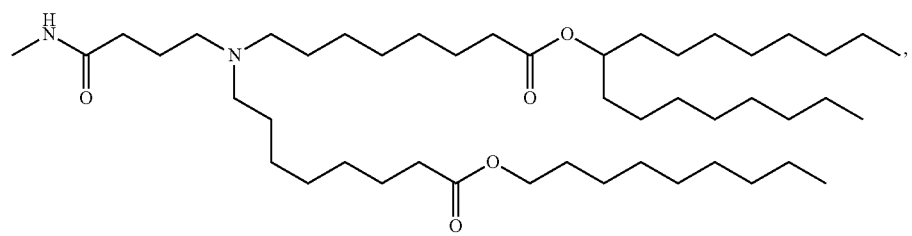
(Compound 223)
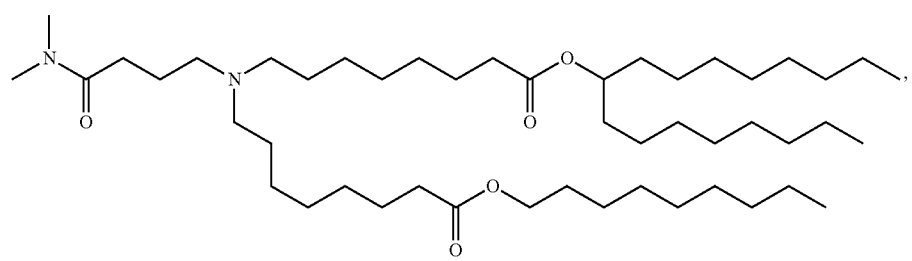
(Compound 224)
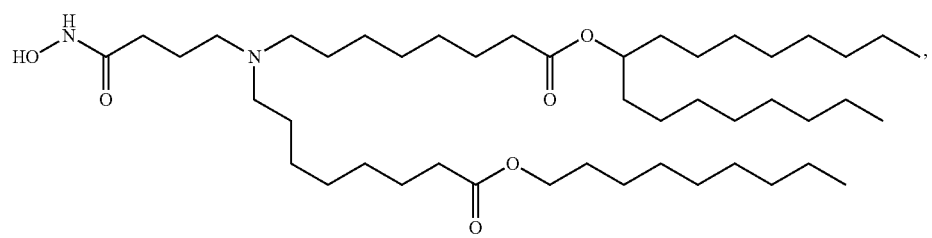
(Compound 225)
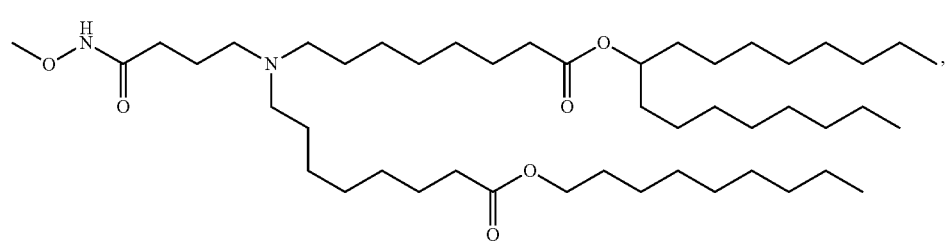
(Compound 226)

(Compound 227)

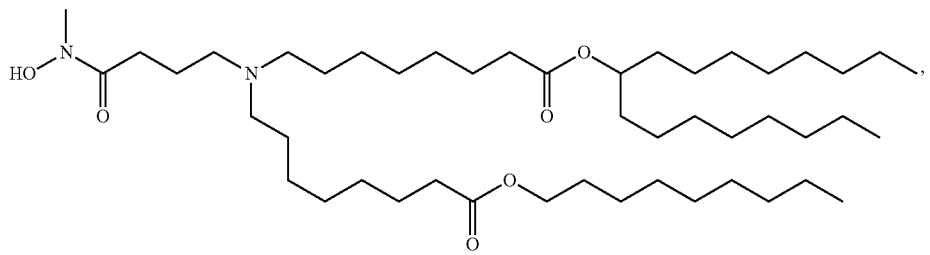

(Compound 228)

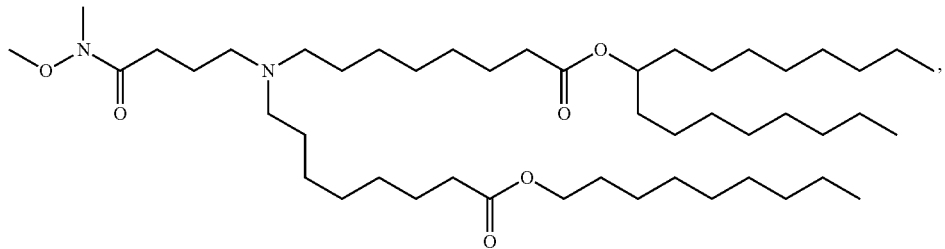

(Compound 229)

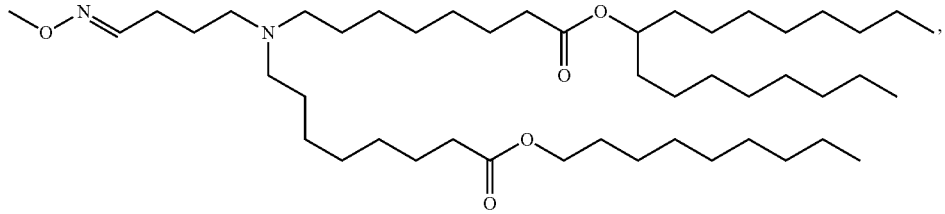

(Compound 232)

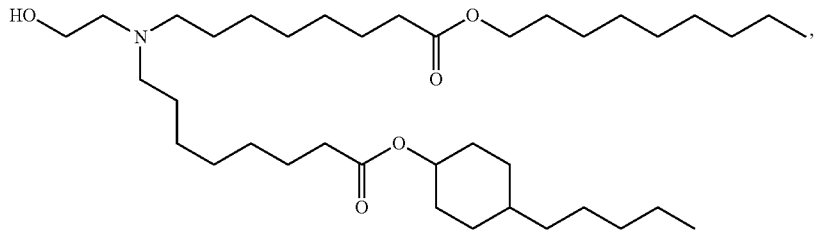

and salts and isomers thereof.

In some embodiments, a nanoparticle comprises the following compound:

(Compound 429)

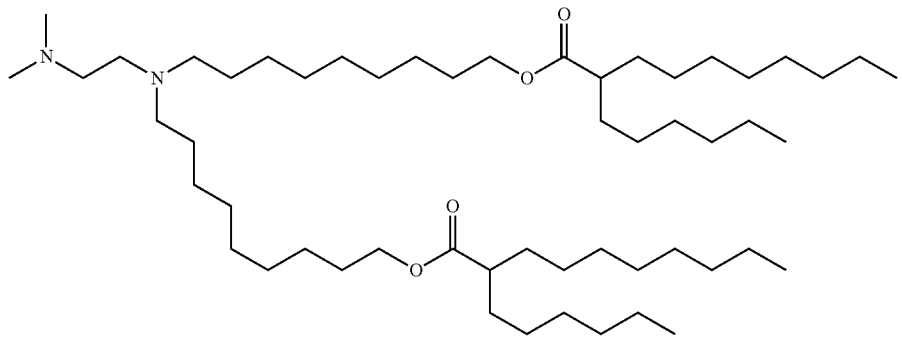

or salts and isomers thereof.

In some embodiments, a lipid nanoparticle composition includes a lipid component comprising a compound as described herein (e.g., a compound according to Formula (I), (IA), (II), (IIa), (IIb), (IIc), (IId) or (IIe)).

In some embodiments LNPs may be comprised of ionizable lipids including a central piperazine moiety. Such LNPs advantageously may be composed of an ionizable lipid, a phospholipid and a PEG lipid and may optionally include a structural lipid or may lack a structural lipid. In some embodiments the phospholipid is a DSPC or DOP.

The ionizable lipids including a central piperazine moiety described herein may be advantageously used in lipid nanoparticle compositions for the delivery of therapeutic and/or prophylactic agents to mammalian cells or organs. For example, the lipids described herein have little or no immunogenicity. For example, the lipid compounds disclosed herein have a lower immunogenicity as compared to a reference lipid (e.g., MC3, KC2, or DLinDMA). For example, a formulation comprising a lipid disclosed herein and a therapeutic or prophylactic agent has an increased therapeutic index as compared to a corresponding formulation which comprises a reference lipid (e.g., MC3, KC2, or DLinDMA) and the same therapeutic or prophylactic agent.

Lipids may be compounds of Formula (III),

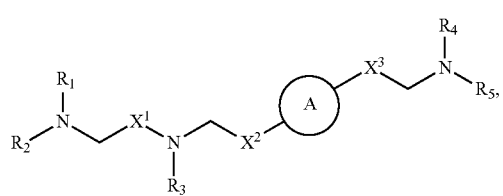

(III)

or salts or isomers thereof, wherein
ring A is

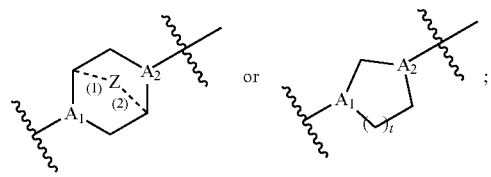

t is 1 or 2;
$A_1$ and $A_2$ are each independently selected from CH or N;
Z is $CH_2$ or absent wherein when Z is $CH_2$, the dashed lines (1) and (2) each represent a single bond; and when Z is absent, the dashed lines (1) and (2) are both absent;
$R_1$, $R_2$, $R_3$, $R_4$, and $R_5$ are independently selected from the group consisting of $C_{5-20}$ alkyl, $C_{5-20}$ alkenyl, —R"MR', —R*YR", —YR", and —R*OR";
each M is independently selected from the group consisting of —C(O)O—, —OC(O)—, —OC(O)O—, —C(O)N(R')—, —N(R')C(O)—, —C(O)—, —C(S)—, —C(S)S—, —SC(S)—, —CH(OH)—, —P(O)(OR')O—, —S(O)$_2$—, an aryl group, and a heteroaryl group;
$X^1$, $X^2$, and $X^3$ are independently selected from the group consisting of a bond, —CH$_2$—, —(CH$_2$)$_2$—, —CHR—, —CHY—, —C(O)—, —C(O)O—, —OC(O)—, —C(O)—CH$_2$—, —CH$_2$—C(O)—, —C(O)O—CH$_2$—, —OC(O)—CH$_2$—, —CH$_2$—C(O)O—, —CH$_2$—OC(O)—, —CH(OH)—, —C(S)—, and —CH(SH)—;
each Y is independently a $C_{3-6}$ carbocycle;
each R* is independently selected from the group consisting of $C_{1-12}$ alkyl and $C_{2-12}$ alkenyl;
each R is independently selected from the group consisting of $C_{1-3}$ alkyl and a $C_{3-6}$ carbocycle;
each R' is independently selected from the group consisting of $C_{1-12}$ alkyl, $C_{2-12}$ alkenyl, and H; and
each R" is independently selected from the group consisting of $C_{3-12}$ alkyl and $C_{3-12}$ alkenyl, wherein when ring A is

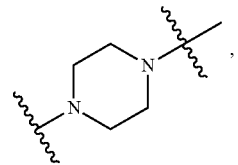 [SMILES: *N1CCN(*)CC1]

then
i) at least one of $X^1$, $X^2$, and $X^3$ is not —CH$_2$—; and/or
ii) at least one of $R_1$, $R_2$, $R_3$, $R_4$, and $R_5$ is —R"MR'.

In some embodiments, the compound is of any of formulae (IIIa1)-(IIIa6):

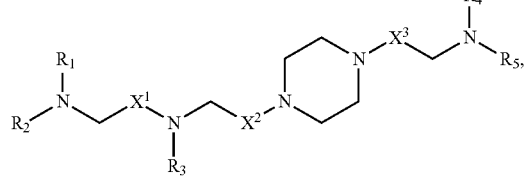

(IIIa1)

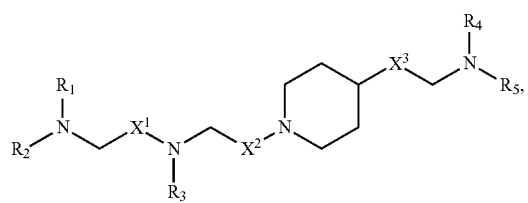

(IIIa2)

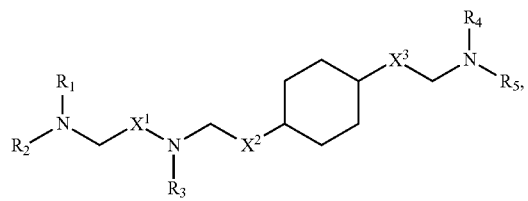

(IIIa3)

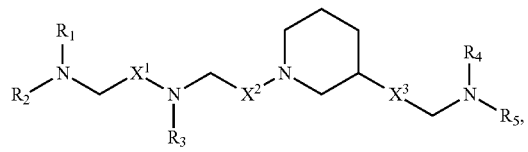

(IIIa4)

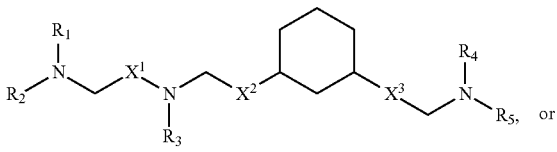

(IIIa5)

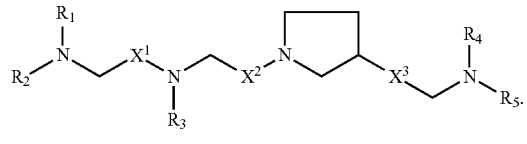

(IIIa6)

The compounds of Formula (III) or any of (IIIa1)-(IIIa6) include one or more of the following features when applicable.

In some embodiments, ring A is

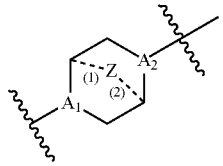

In some embodiments, ring A is

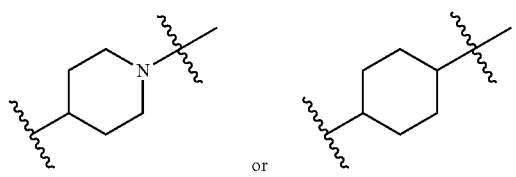

In some embodiments, ring A is

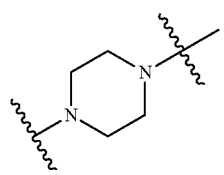

In some embodiments, ring A is

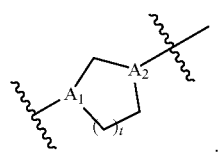

In some embodiments, ring A is

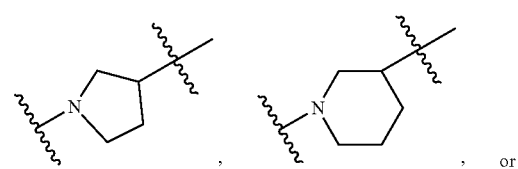

In some embodiments, ring A is

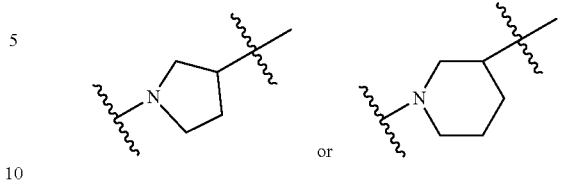

wherein ring, in which the N atom is connected with $X^2$.

In some embodiments, Z is CH2.

In some embodiments, Z is absent.

In some embodiments, at least one of A1 and A2 is N.

In some embodiments, each of A1 and A2 is N.

In some embodiments, each of A1 and A2 is CH.

In some embodiments, A1 is N and A2 is CH.

In some embodiments, A1 is CH and A2 is N.

In some embodiments, at least one of $X^1$, $X^2$, and $X^3$ is not —CH$_2$—. For example, in certain embodiments, $X^1$ is not —CH$_2$—. In some embodiments, at least one of $X^1$, $X^2$, and $X^3$ is —C(O)—.

In some embodiments, $X^2$ is —C(O)—, —C(O)O—, —OC(O)—, —C(O)—CH$_2$—, —CH$_2$—C(O)—, —C(O)O—CH$_2$—, —OC(O)—CH$_2$—, —CH$_2$—C(O)O—, or —CH$_2$—OC(O)—.

In some embodiments, $X^3$ is —C(O)—, —C(O)O—, —OC(O)—, —C(O)—CH$_2$—, —CH$_2$—C(O)—, —C(O)O—CH$_2$—, —OC(O)—CH$_2$—, —CH$_2$—C(O)O—, or —CH$_2$—OC(O)—. In other embodiments, $X^3$ is —CH$_2$—.

In some embodiments, $X^3$ is a bond or —(CH$_2$)$_2$—.

In some embodiments, $R_1$ and $R_2$ are the same. In certain embodiments, R1, R2, and R3 are the same. In some embodiments, $R_4$ and $R_5$ are the same. In certain embodiments, R1, R2, R3, R4, and R5 are the same.

In some embodiments, at least one of $R_1$, $R_2$, $R_3$, $R_4$, and $R_5$ is —R"MR'. In some embodiments, at most one of $R_1$, $R_2$, $R_3$, $R_4$, and $R_5$ is —R"MR'. For example, at least one of $R_1$, $R_2$, and $R_3$ may be —R"MR', and/or at least one of $R_4$ and $R_5$ is —R"MR'. In certain embodiments, at least one M is —C(O)O—. In some embodiments, each M is —C(O)O—. In some embodiments, at least one M is —OC(O)—. In some embodiments, each M is —OC(O)—. In some embodiments, at least one M is —OC(O)O—. In some embodiments, each M is —OC(O)O—. In some embodiments, at least one R" is C$_3$ alkyl. In certain embodiments, each R" is C$_3$ alkyl. In some embodiments, at least one R" is C$_5$ alkyl. In certain embodiments, each R" is C$_5$ alkyl. In some embodiments, at least one R" is C$_6$ alkyl. In certain embodiments, each R" is C$_6$ alkyl. In some embodiments, at least one R" is C$_7$ alkyl. In certain embodiments, each R" is C$_7$ alkyl. In some embodiments, at least one R' is C$_5$ alkyl. In certain embodiments, each R' is C$_5$ alkyl. In other embodiments, at least one R' is C$_1$ alkyl. In certain embodiments, each R' is C$_1$ alkyl. In some embodiments, at least one R' is C$_2$ alkyl. In certain embodiments, each R' is C$_2$ alkyl.

In some embodiments, at least one of $R_1$, $R_2$, $R_3$, $R_4$, and $R_5$ is C$_{12}$ alkyl. In certain embodiments, each of $R_1$, $R_2$, $R_3$, $R_4$, and $R_5$ are C$_{12}$ alkyl.

In certain embodiments, the compound is selected from the group consisting of:

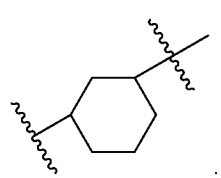

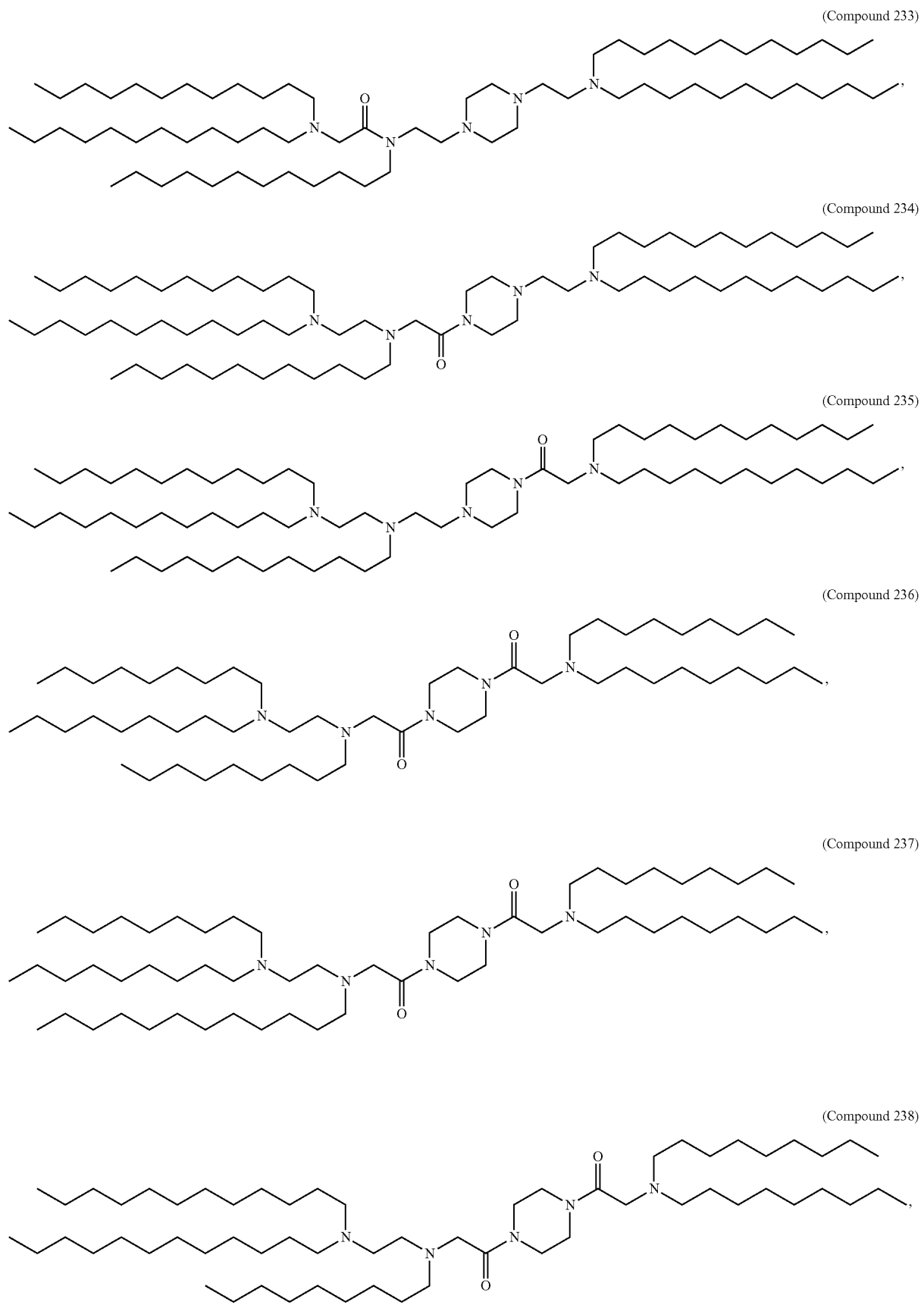

(Compound 239)
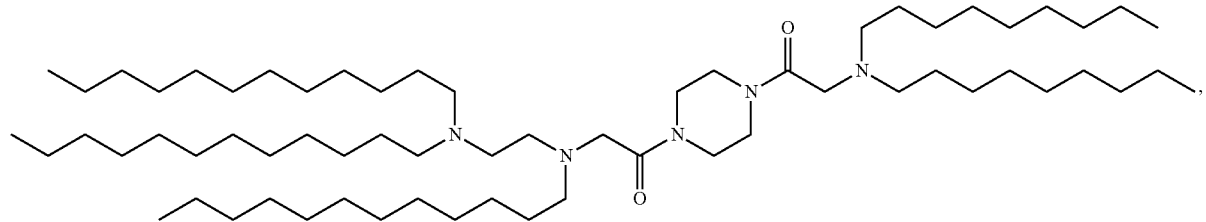
(Compound 240)
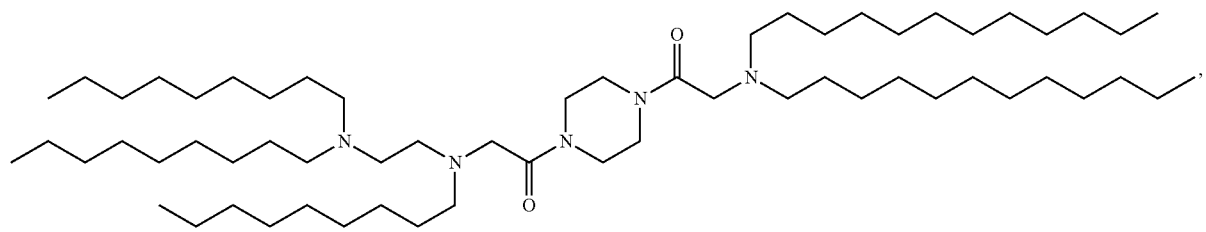
(Compound 241)
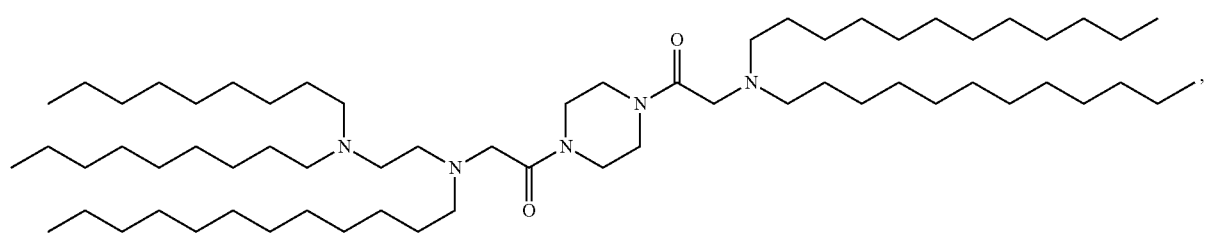
(Compound 242)
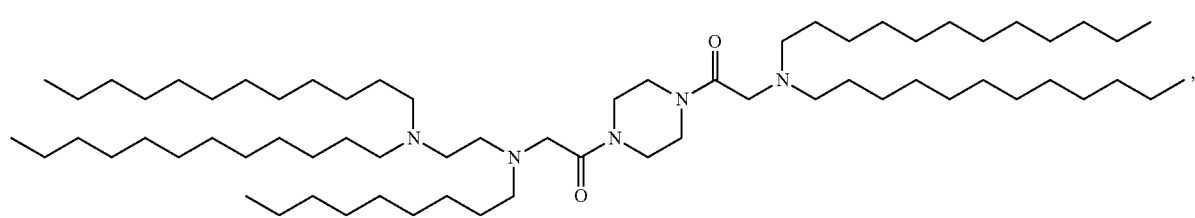
(Compound 243)
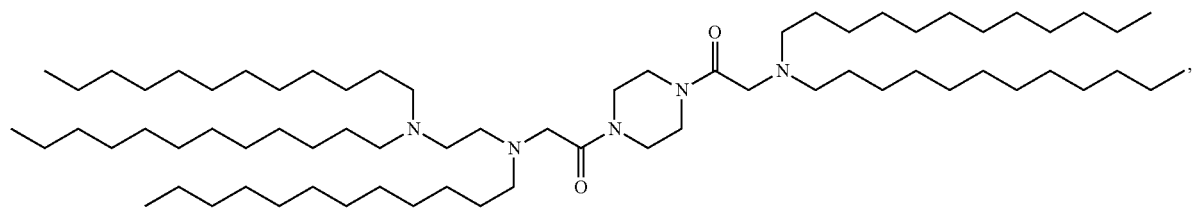
(Compound 244)
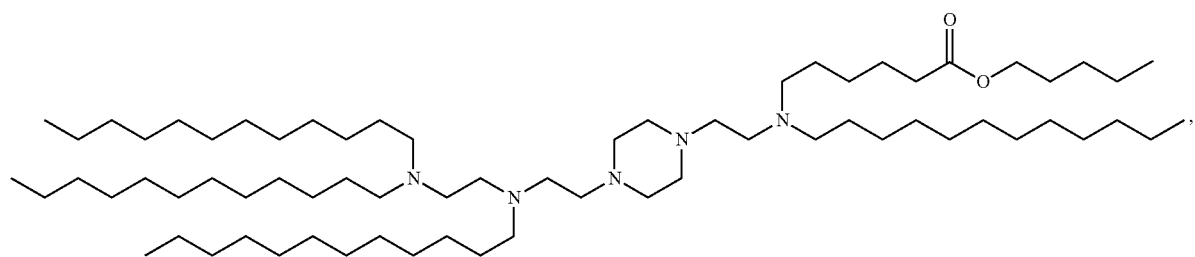

-continued
(Compound 245)
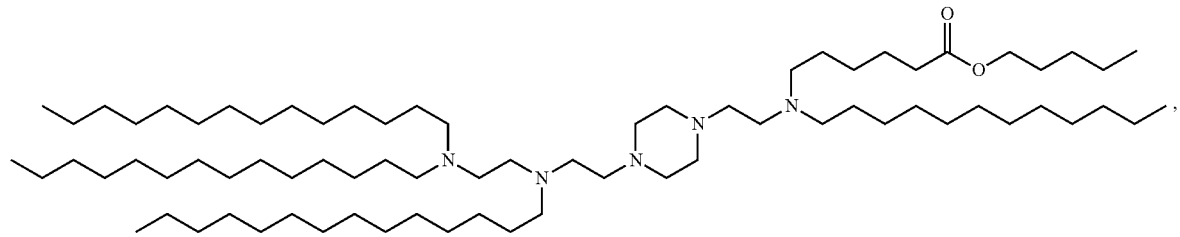
(Compound 246)
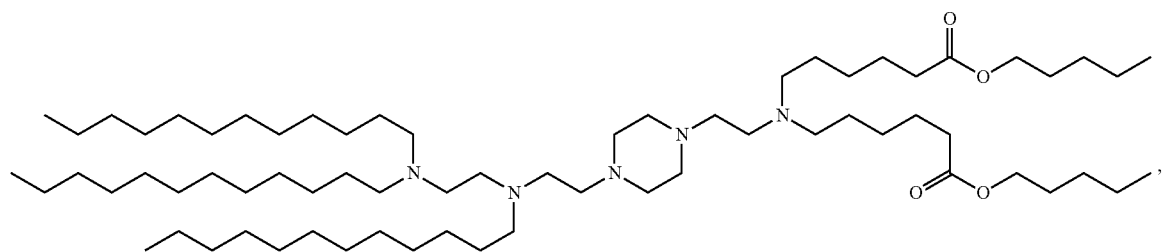
(Compound 247)
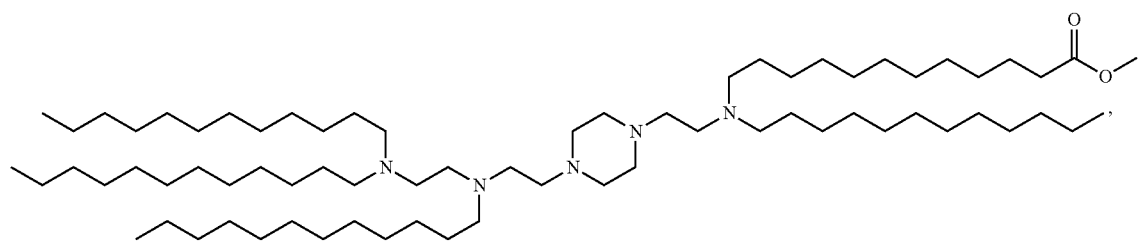
(Compound 248)
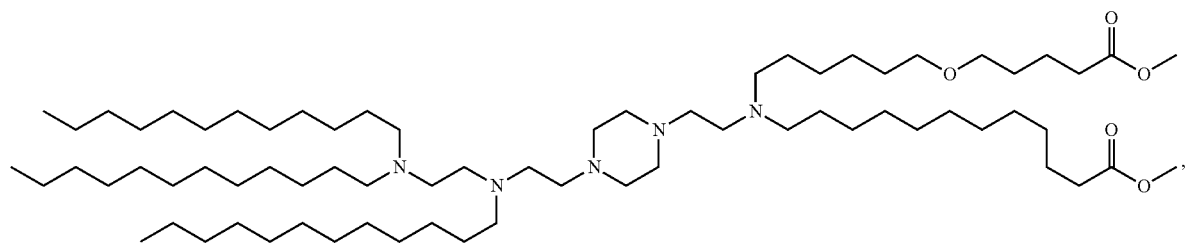
(Compound 274)
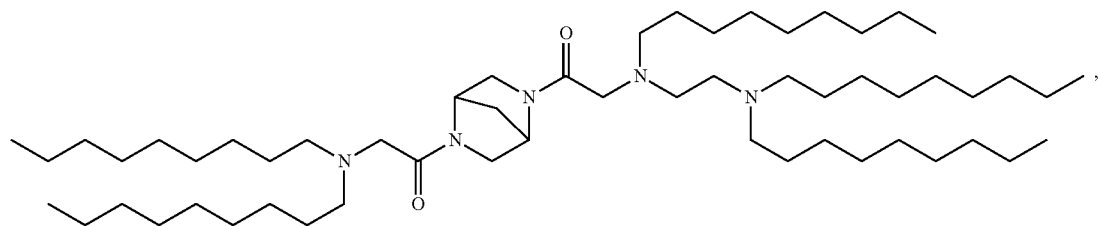
(Compound 275)
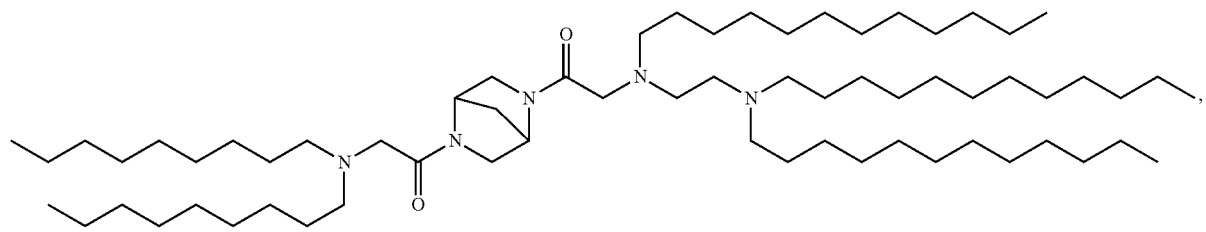

(Compound 276)
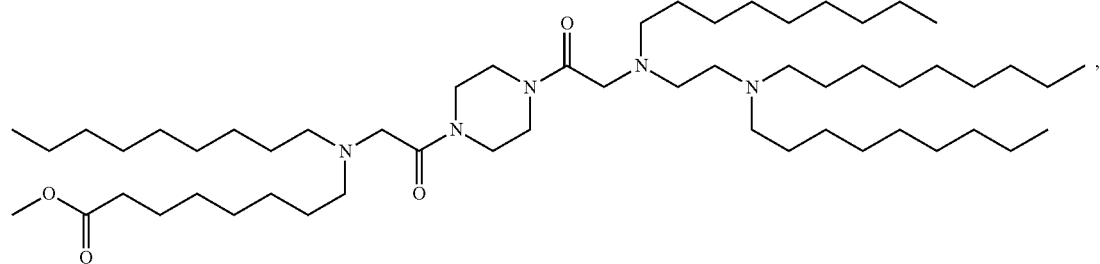
(Compound 277)
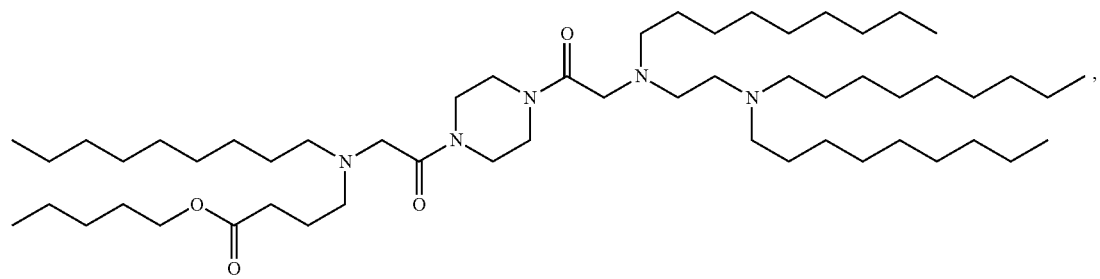
(Compound 278)
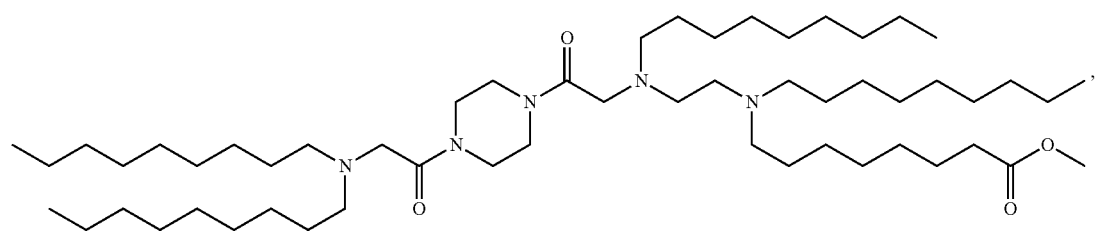
(Compound 279)
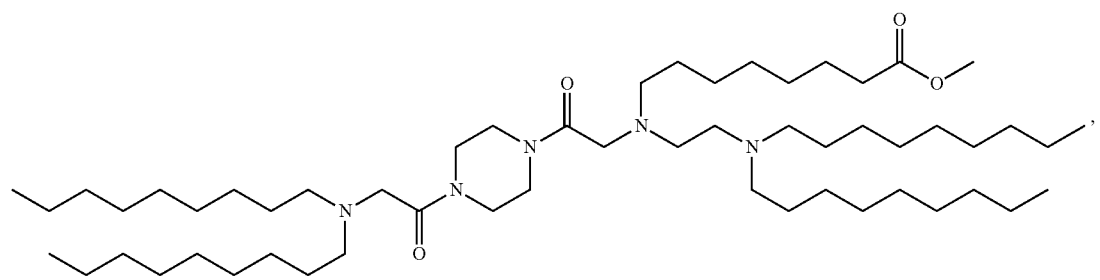
(Compound 280)
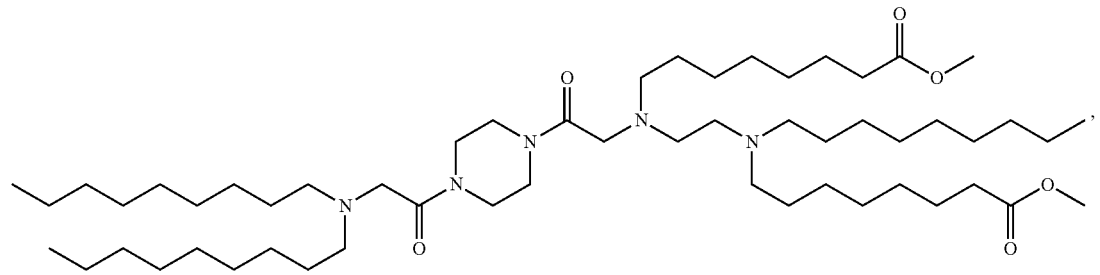

(Compound 281)
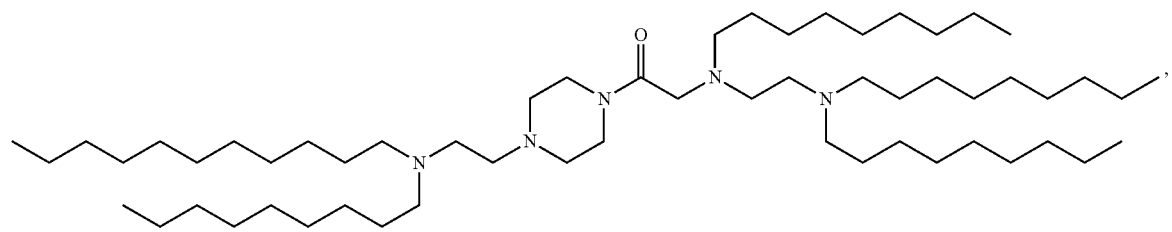
(Compound 282)
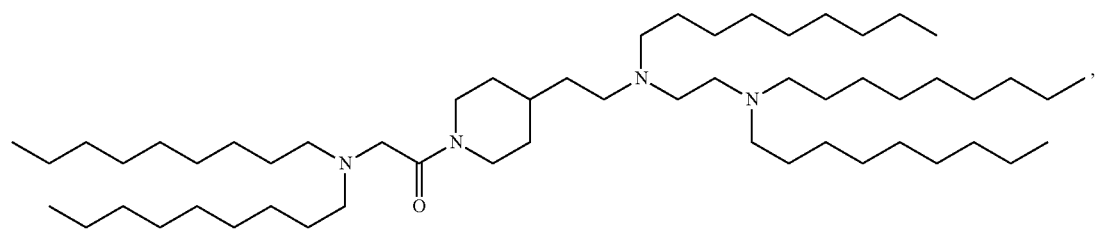
(Compound 283)
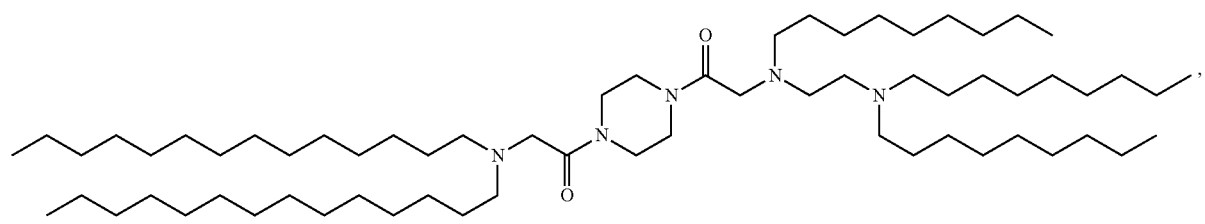
(Compound 284)
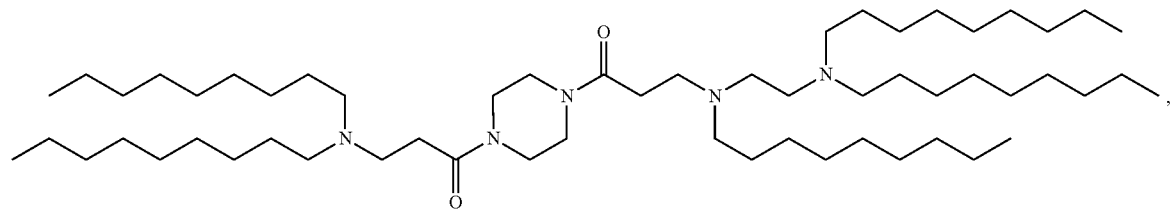
(Compound 285)
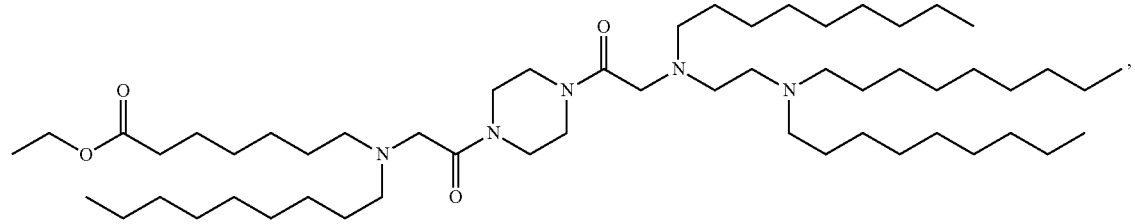
(Compound 286)
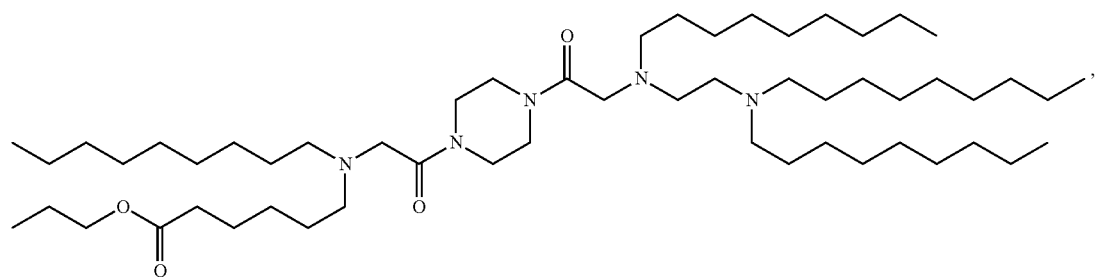

-continued
(Compound 287)
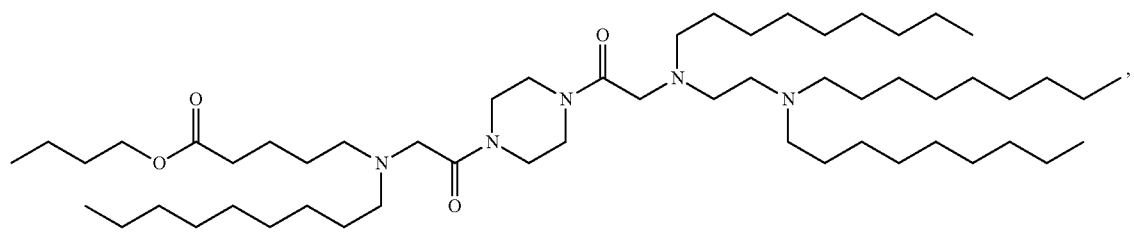
(Compound 288)
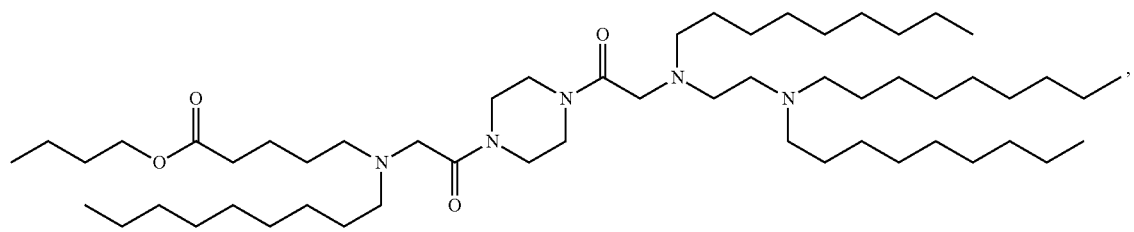
(Compound 289)
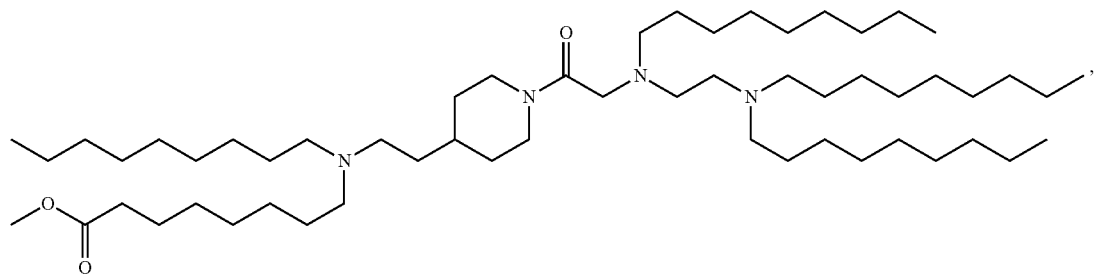
(Compound 290)
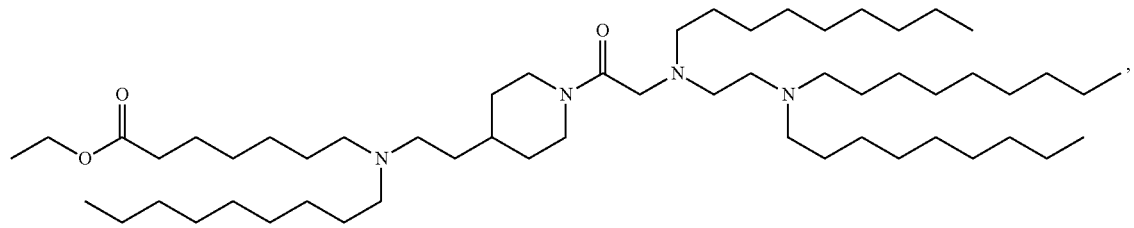
(Compound 291)
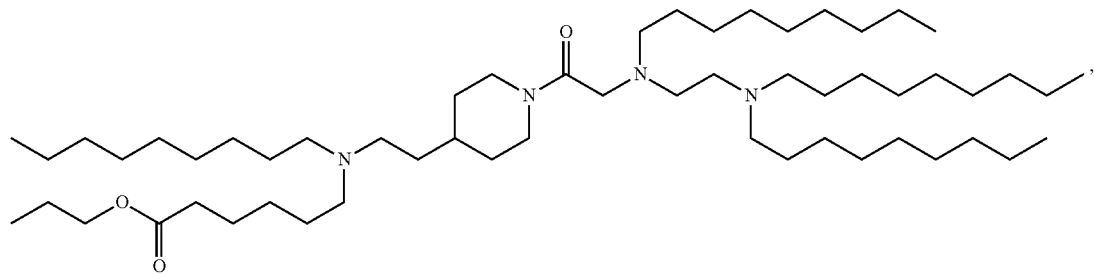
(Compound 292)
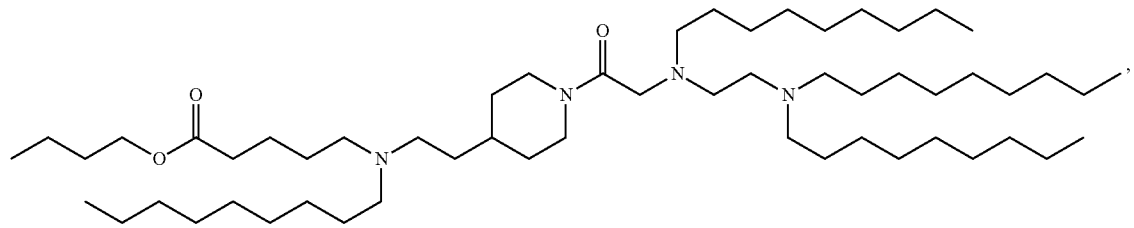

(Compound 293)
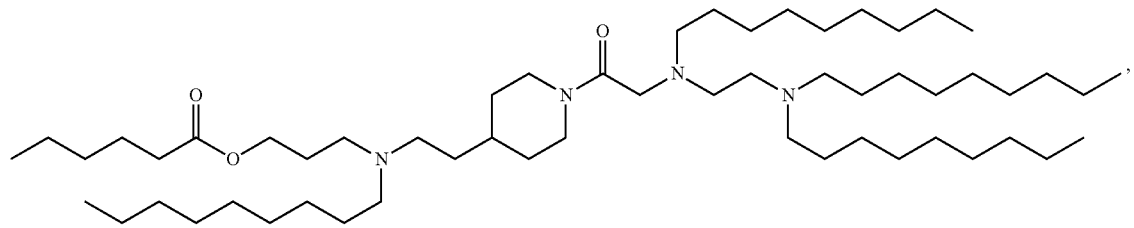
(Compound 294)
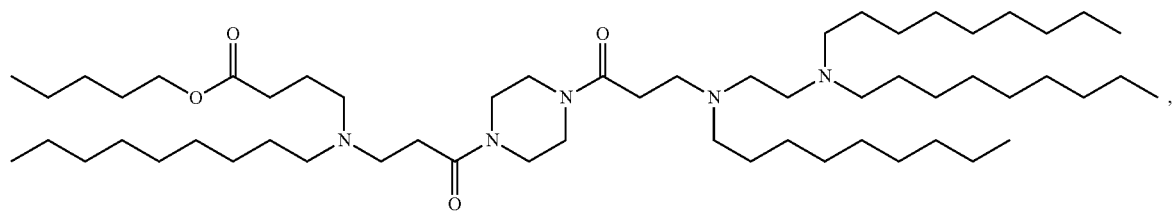
(Compound 295)
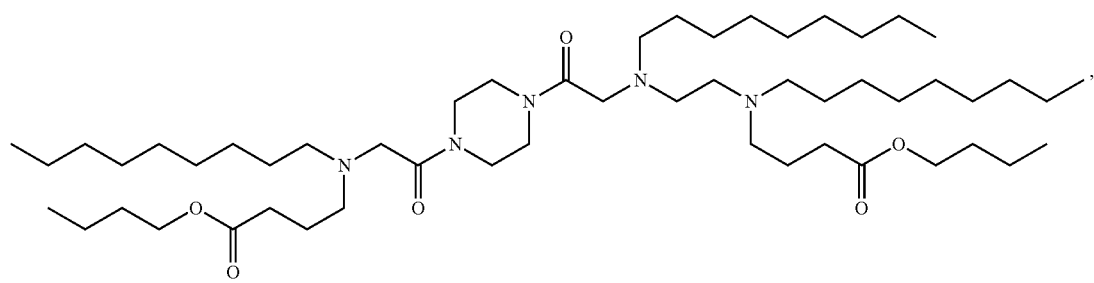
(Compound 296)
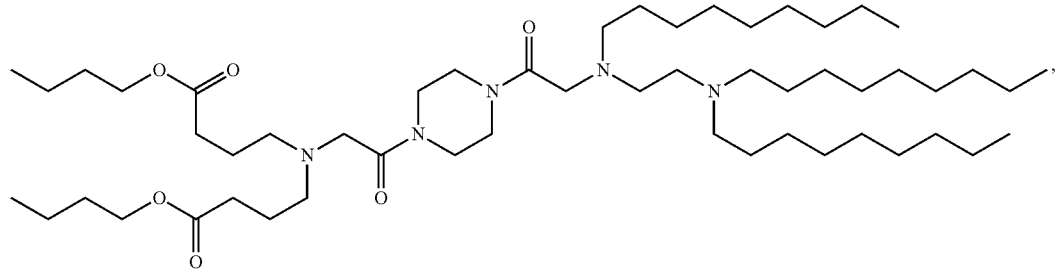
(Compound 297)
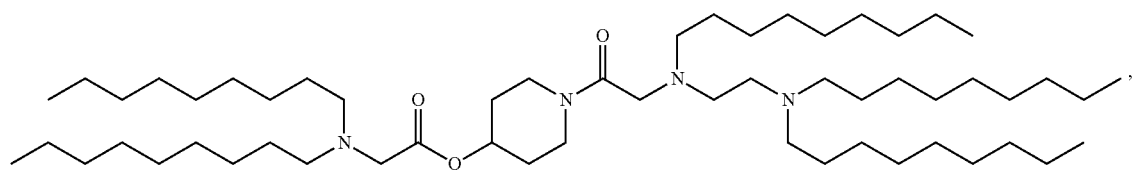
(Compound 298)
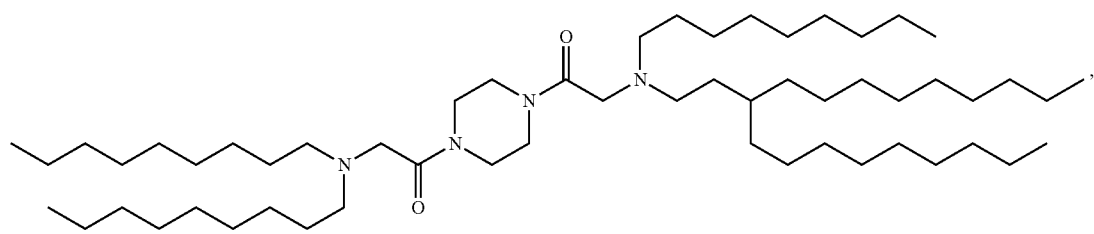

-continued
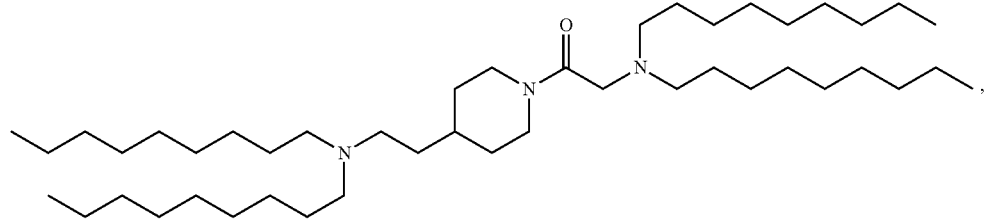
(Compound 300)
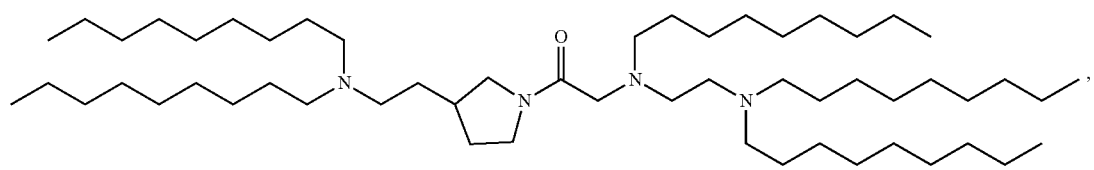
(Compound 301)
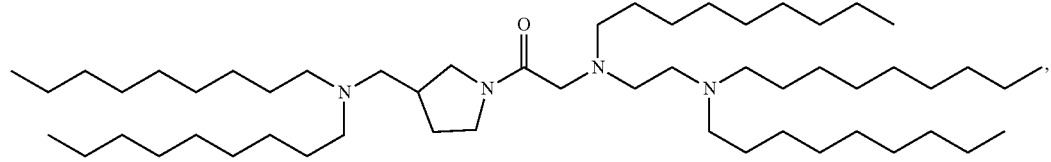
(Compound 302)
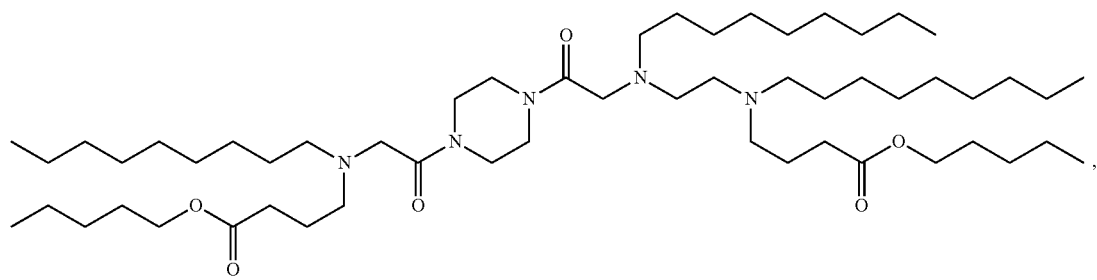
(Compound 303)
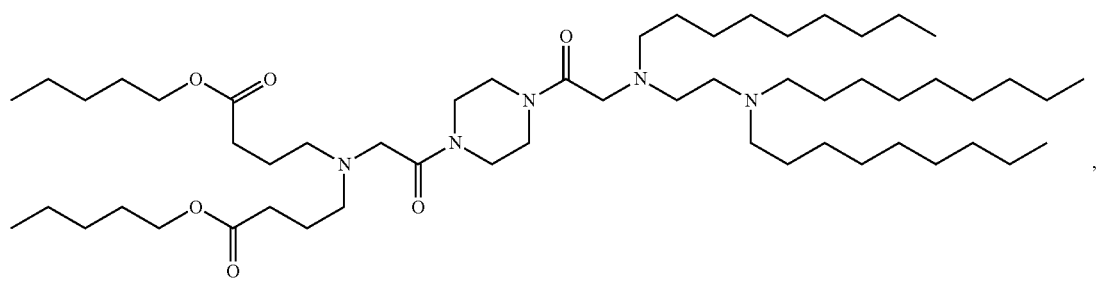
(Compound 304)
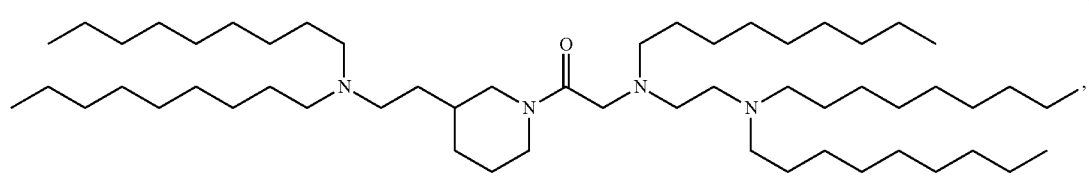
(Compound 305)
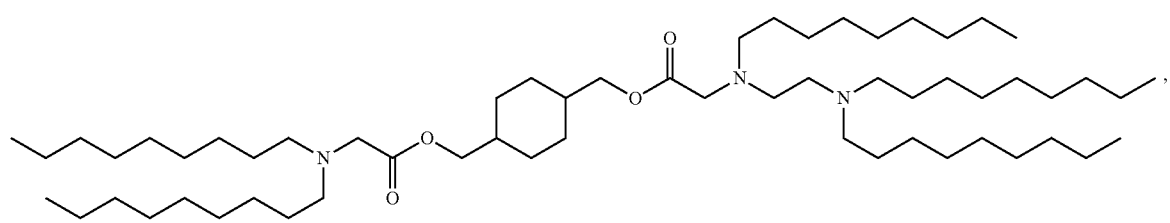
(Compound 306)

(Compound 307)
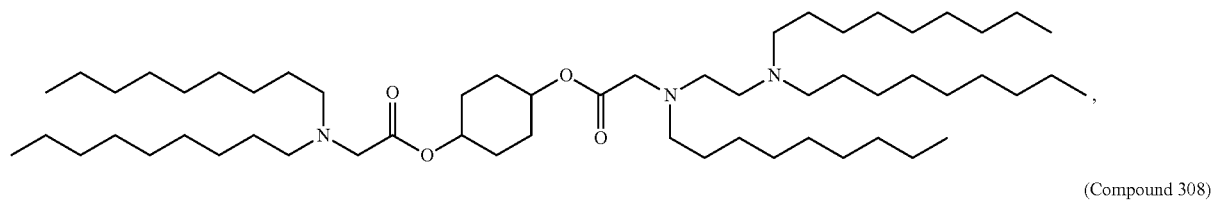
(Compound 308)
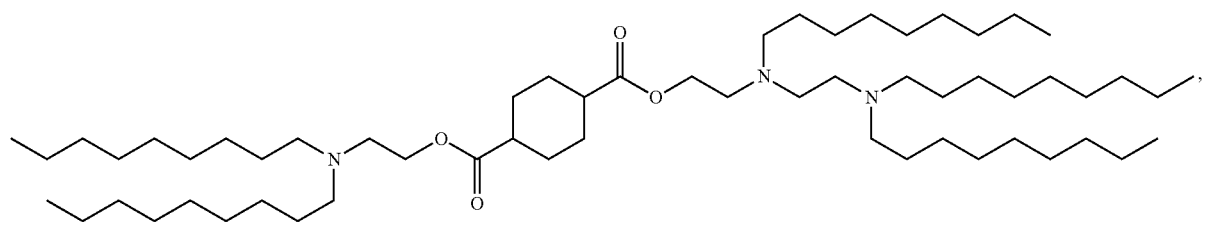
(Compound 310)
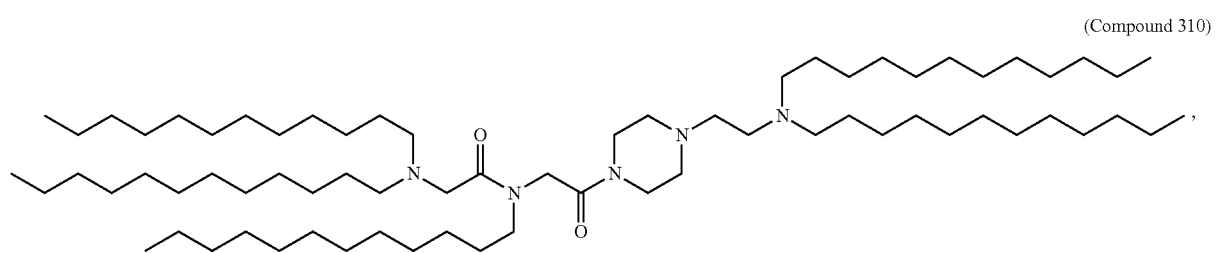
(Compound 311)
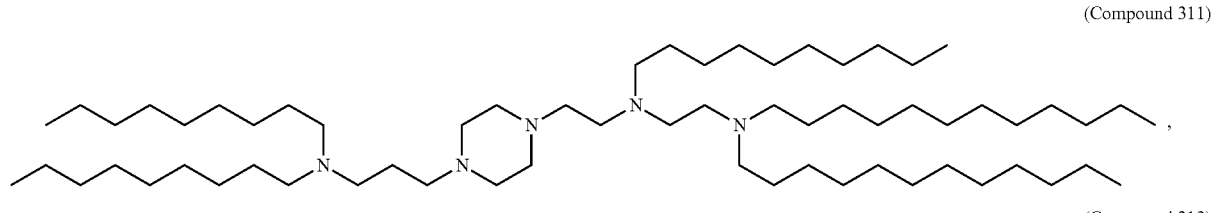
(Compound 312)
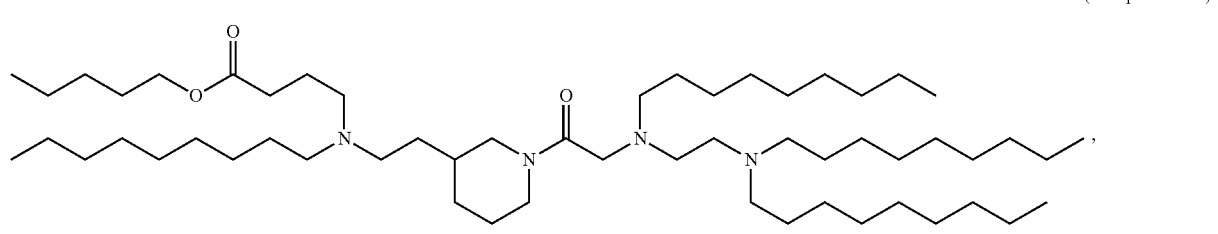
(Compound 313)
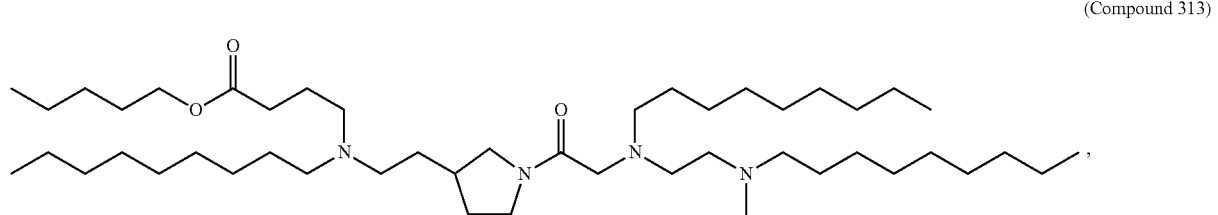
(Compound 314)
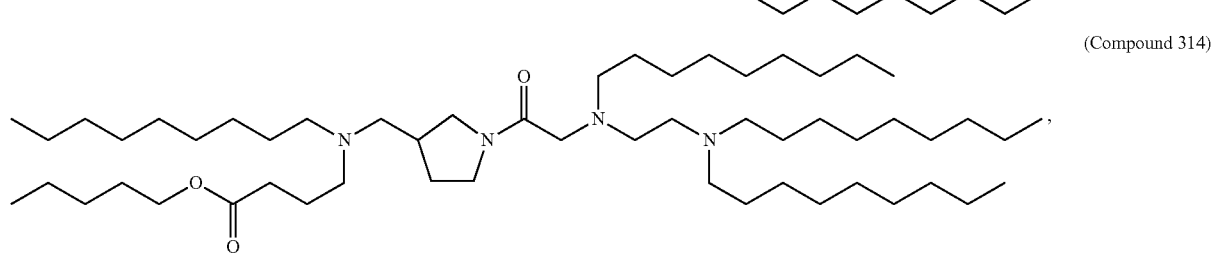

-continued
(Compound 315)
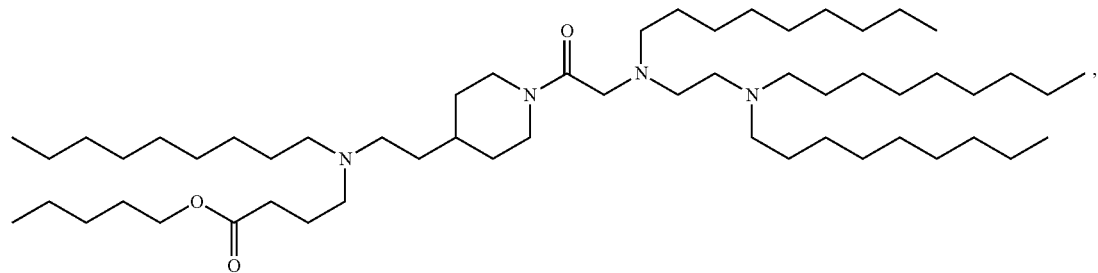
(Compound 316)
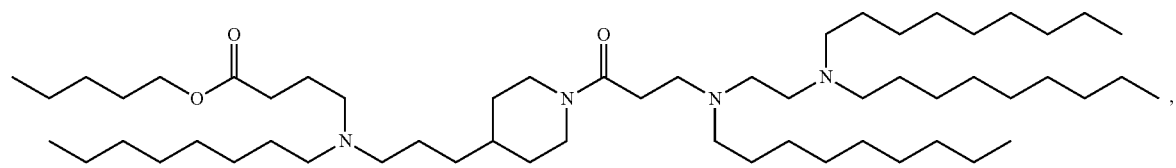
(Compound 317)
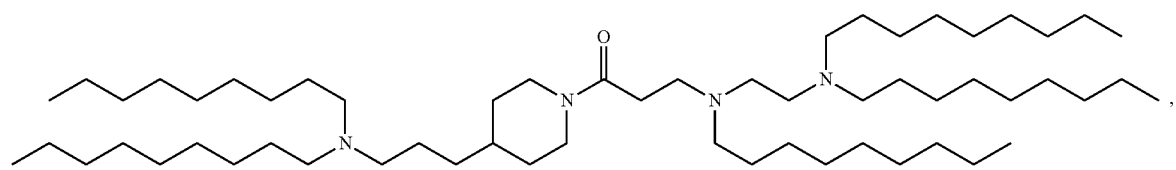
(Compound 318)
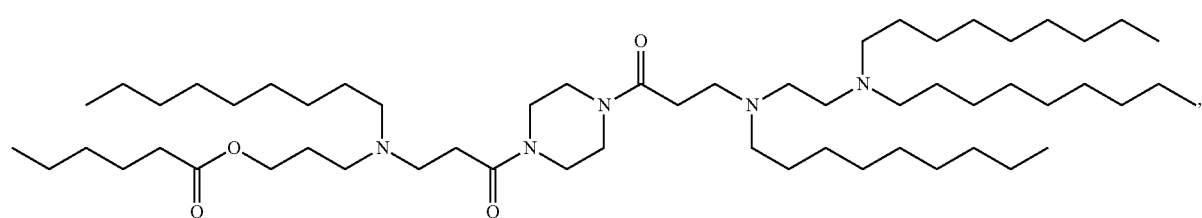
(Compound 319)
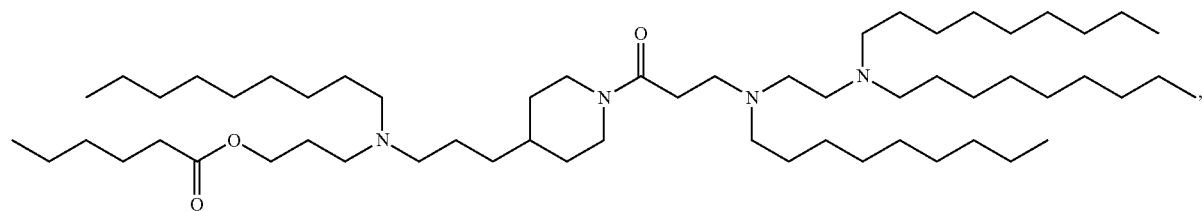
(Compound 320)
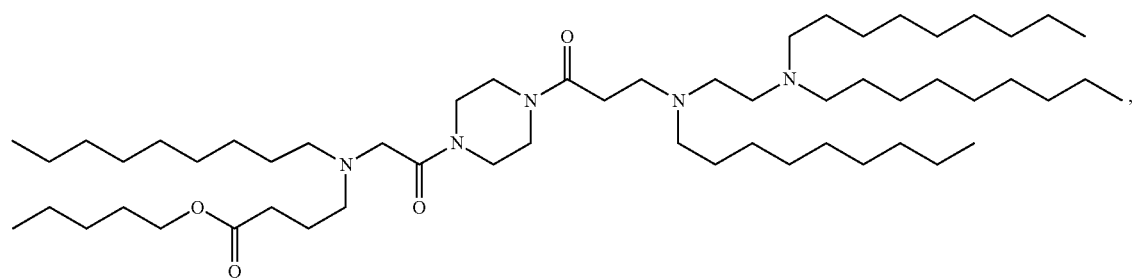

(Compound 321)
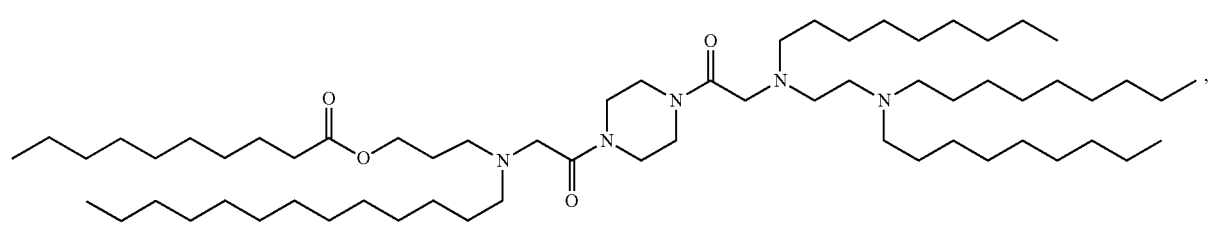
(Compound 322)
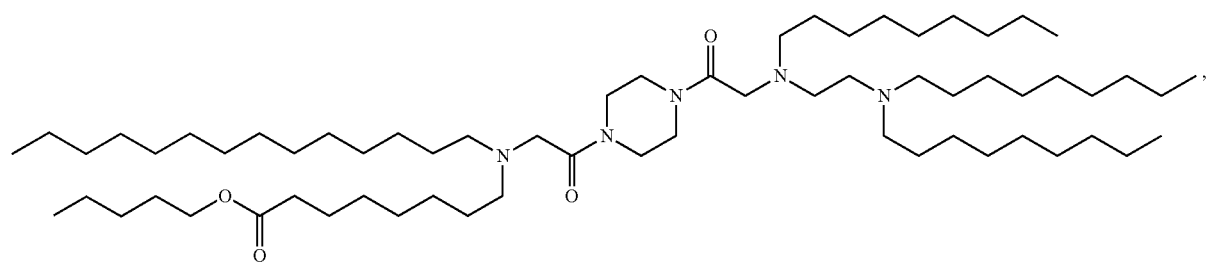
(Compound 323)
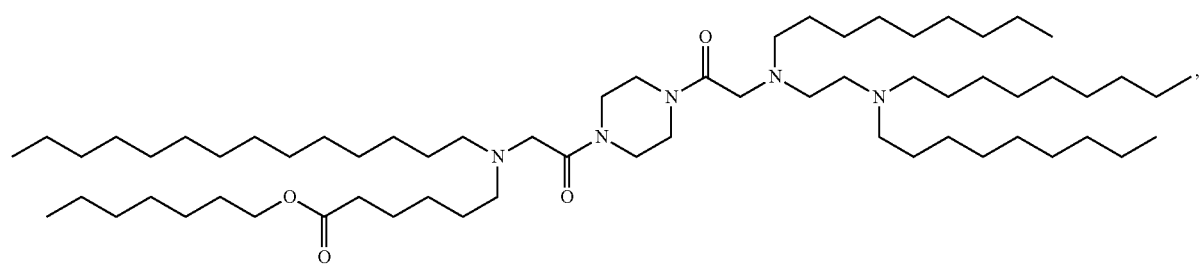
(Compound 324)
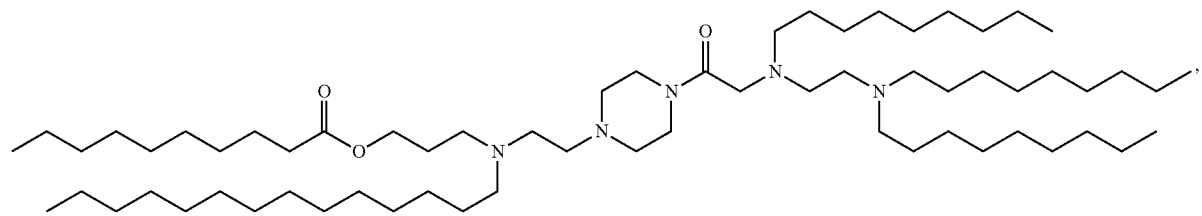
(Compound 325)
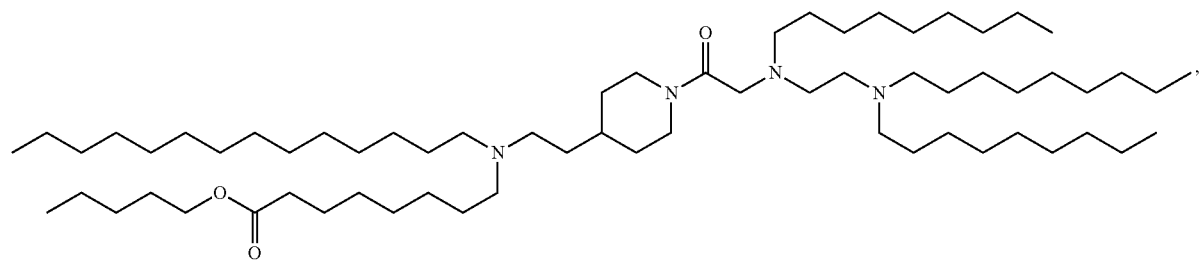
(Compound 326)
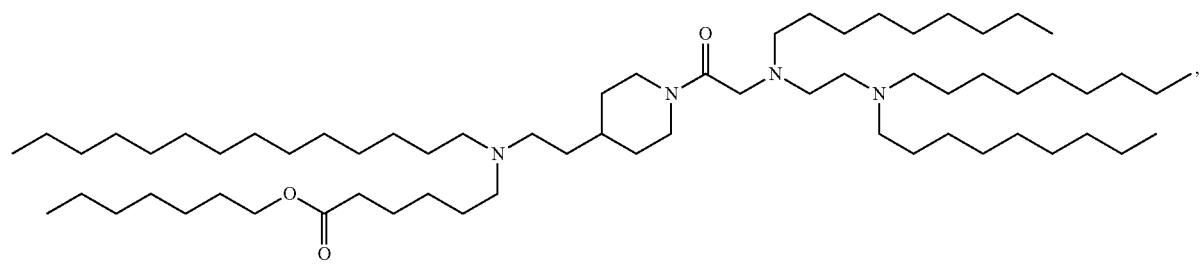

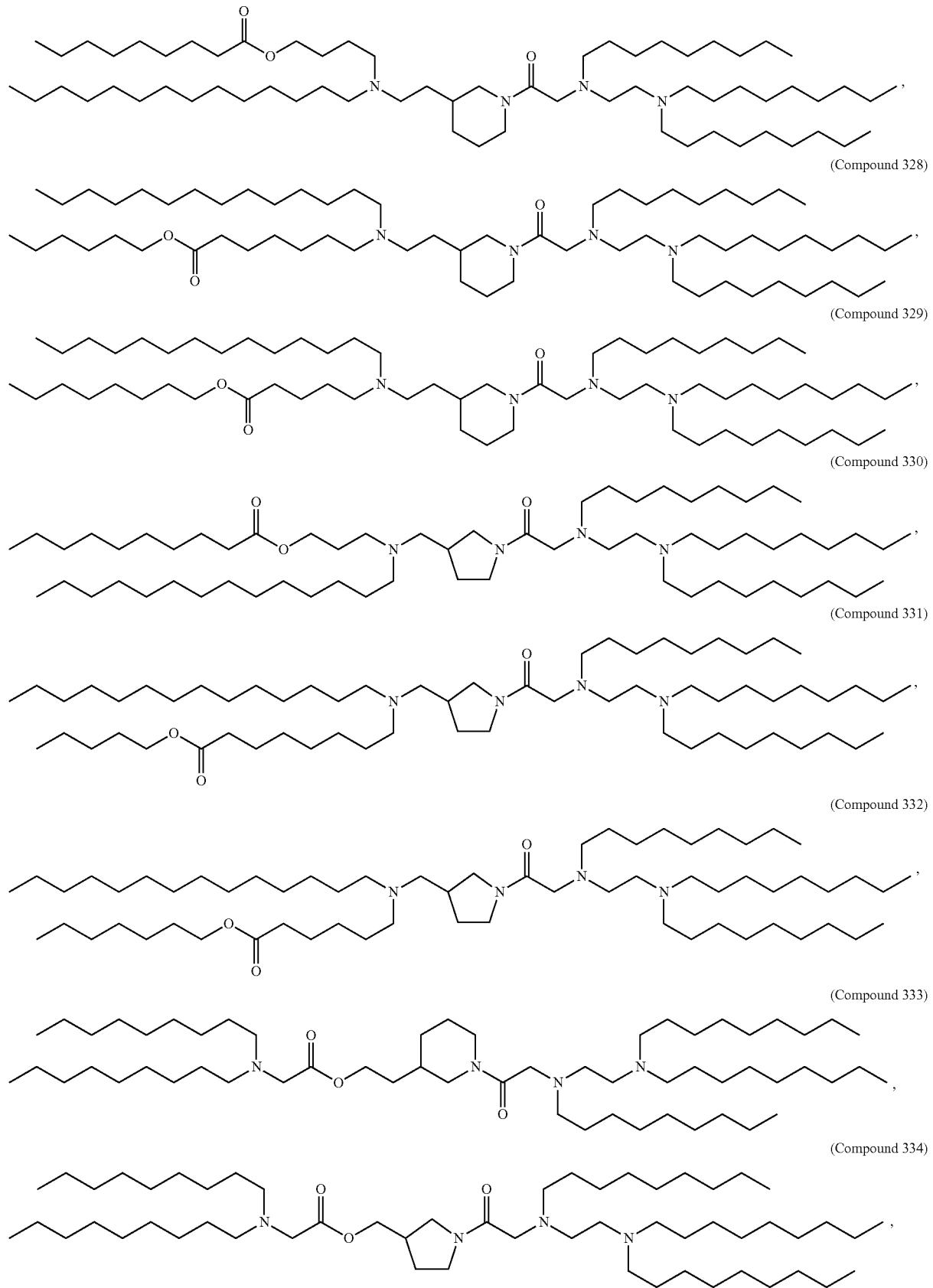

(Compound 335)
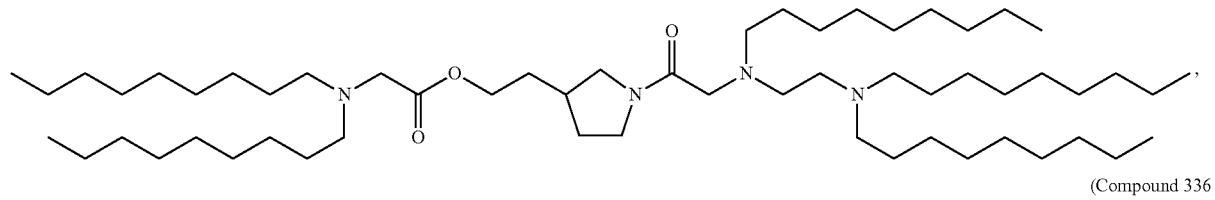
(Compound 336)
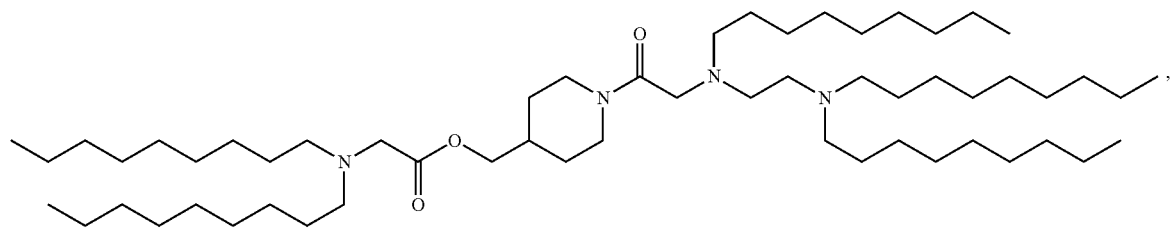
(Compound 337)
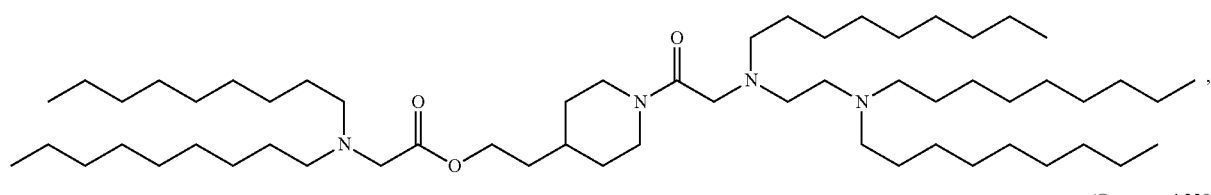
(Compound 338)
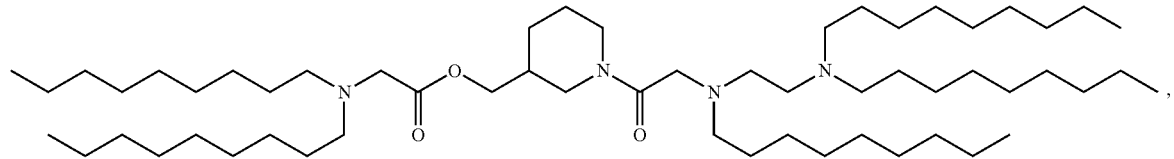
(Compound 339)
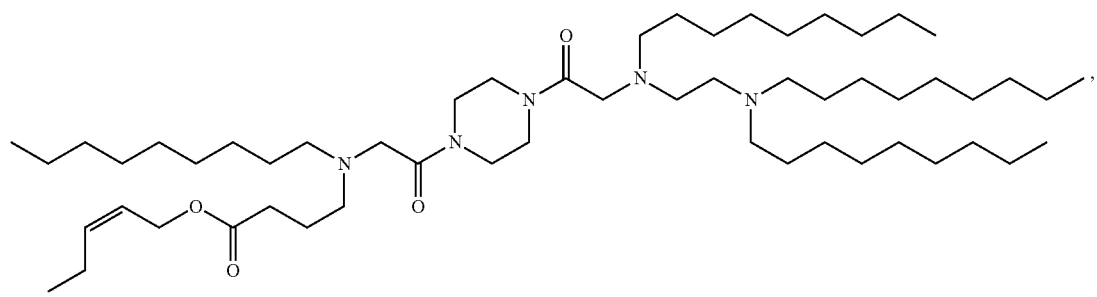
(Compound 340)
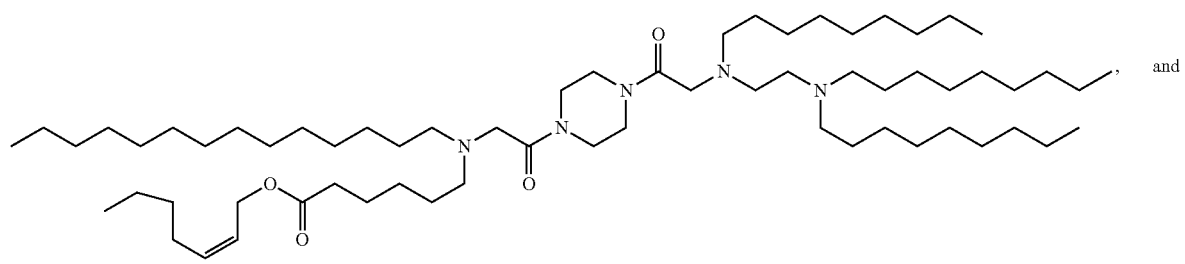
and

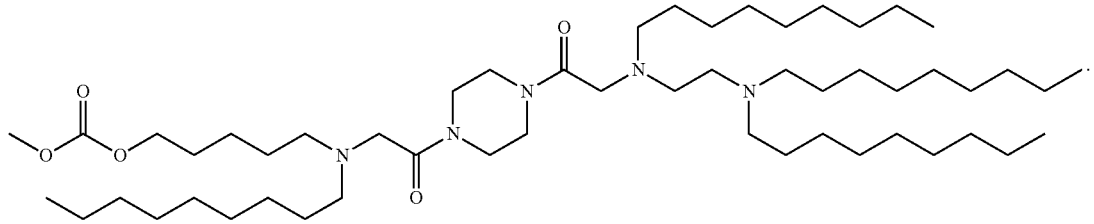

(Compound 341)

In other embodiments, a lipid has the Formula (IV)

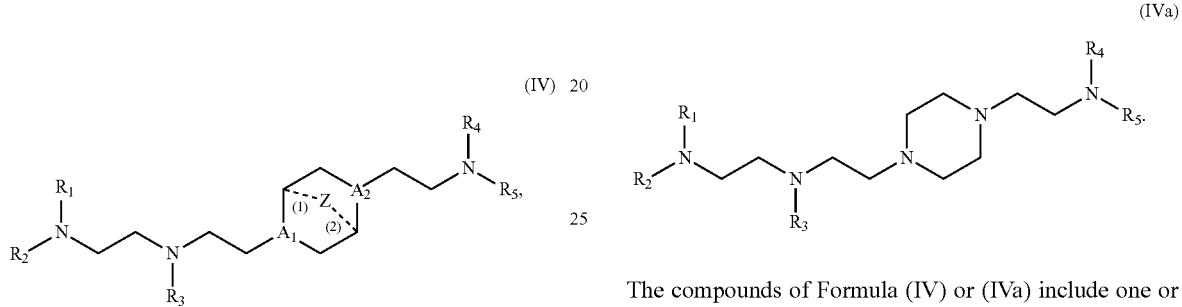

or a salt or isomer thereof, wherein $A_1$ and $A_2$ are each independently selected from CH or N and at least one of $A_1$ and $A_2$ is N;

Z is $CH_2$ or absent wherein when Z is $CH_2$, the dashed lines (1) and (2) each represent a single bond; and when Z is absent, the dashed lines (1) and (2) are both absent;

$R_1$, $R_2$, $R_3$, $R_4$, and $R_5$ are independently selected from the group consisting of $C_{6-20}$ alkyl and $C_{6-20}$ alkenyl;

wherein when ring A is

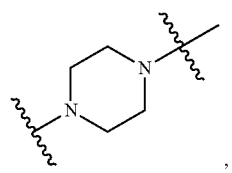 [SMILES: *N1CCN(*)CC1 ; ","]

then i) $R_1$, $R_2$, $R_3$, $R_4$, and $R_5$ are the same, wherein $R_1$ is not $C_{12}$ alkyl, $C_{18}$ alkyl, or $C_{18}$ alkenyl;

ii) only one of $R_1$, $R_2$, $R_3$, $R_4$, and $R_5$ is selected from $C_{6-20}$ alkenyl;

iii) at least one of $R_1$, $R_2$, $R_3$, $R_4$, and $R_5$ have a different number of carbon atoms than at least one other of $R_1$, $R_2$, $R_3$, $R_4$, and $R_5$;

iv) $R_1$, $R_2$, and $R_3$ are selected from $C_{6-20}$ alkenyl, and $R_4$ and $R_5$ are selected from $C_{6-20}$ alkyl; or v) $R_1$, $R_2$, and $R_3$ are selected from $C_{6-20}$ alkyl, and $R_4$ and $R_5$ are selected from $C_{6-20}$ alkenyl.

In some embodiments, the compound is of Formula (IVa):

(IVa)

The compounds of Formula (IV) or (IVa) include one or more of the following features when applicable.

In some embodiments, Z is CH2.
In some embodiments, Z is absent.
In some embodiments, at least one of A1 and A2 is N.
In some embodiments, each of A1 and A2 is N.
In some embodiments, each of A1 and A2 is CH.
In some embodiments, A1 is N and A2 is CH.
In some embodiments, A1 is CH and A2 is N.

In some embodiments, R1, R2, R3, R4, and R5 are the same, and are not C12 alkyl, C18 alkyl, or C18 alkenyl. In some embodiments, R1, R2, R3, R4, and R5 are the same and are C9 alkyl or C14 alkyl.

In some embodiments, only one of R1, R2, R3, R4, and R5 is selected from C6-20 alkenyl. In certain such embodiments, R1, R2, R3, R4, and R5 have the same number of carbon atoms. In some embodiments, R4 is selected from C5-20 alkenyl. For example, R4 may be C12 alkenyl or C18 alkenyl.

In some embodiments, at least one of R1, R2, R3, R4, and R5 have a different number of carbon atoms than at least one other of R1, R2, R3, R4, and R5.

In certain embodiments, R1, R2, and R3 are selected from C6-20 alkenyl, and R4 and R5 are selected from C6-20 alkyl. In other embodiments, $R_1$, $R_2$, and $R_3$ are selected from $C_{6-20}$ alkyl, and $R_4$ and $R_5$ are selected from $C_{6-20}$ alkenyl. In some embodiments, $R_1$, $R_2$, and $R_3$ have the same number of carbon atoms, and/or $R_4$ and $R_5$ have the same number of carbon atoms. For example, $R_1$, $R_2$, and $R_3$, or $R_4$ and $R_5$, may have 6, 8, 9, 12, 14, or 18 carbon atoms. In some embodiments, R1, R2, and R3, or R4 and R5, are C18 alkenyl (e.g., linoleyl). In some embodiments, R1, R2, and R3, or R4 and R5, are alkyl groups including 6, 8, 9, 12, or 14 carbon atoms.

In some embodiments, R1 has a different number of carbon atoms than R2, R3, R4, and R5. In other embodiments, R3 has a different number of carbon atoms than R1, R2, R4, and R5. In further embodiments, R4 has a different number of carbon atoms than R1, R2, R3, and R5.

In some embodiments, the compound is selected from the group consisting of:
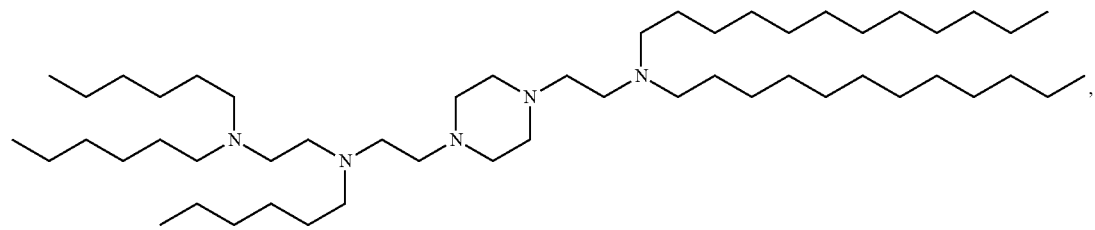
(Compound 249)
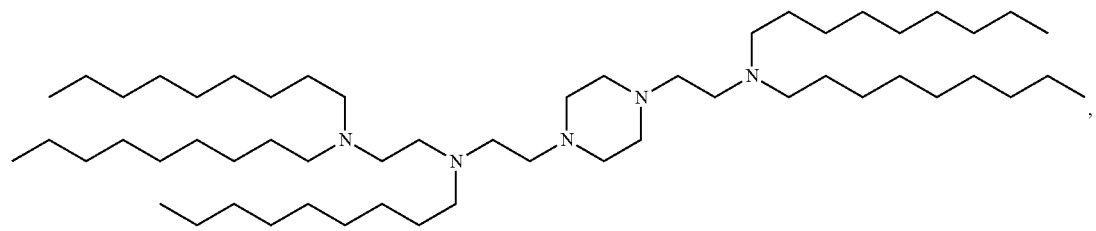
(Compound 250)
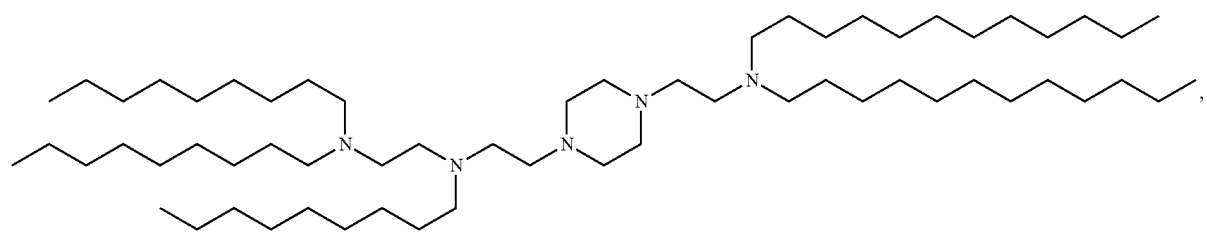
(Compound 251)
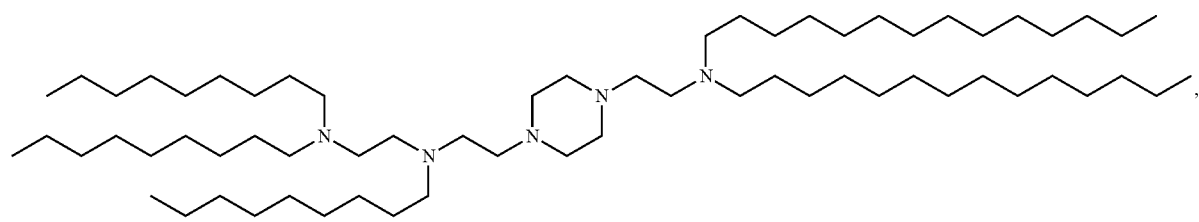
(Compound 252)
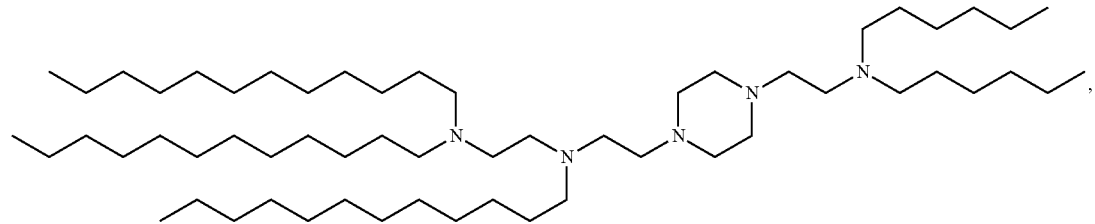
(Compound 253)
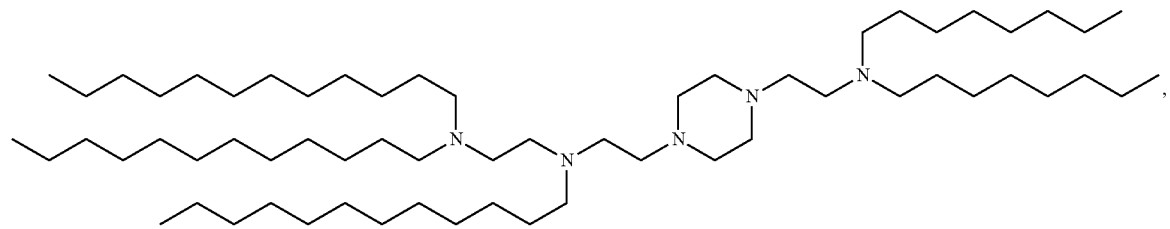
(Compound 254)

-continued
(Compound 255)
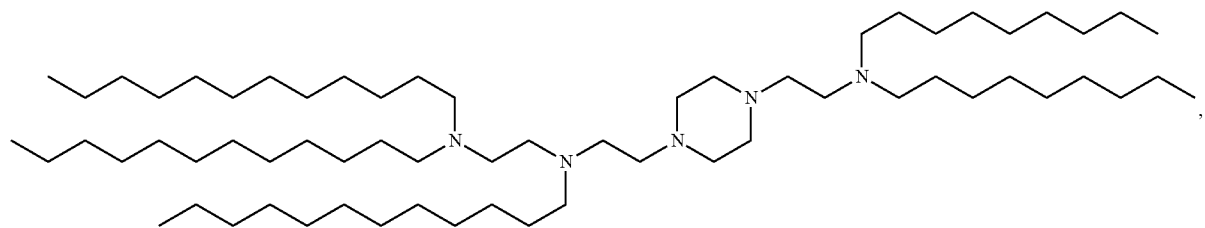
(Compound 256)
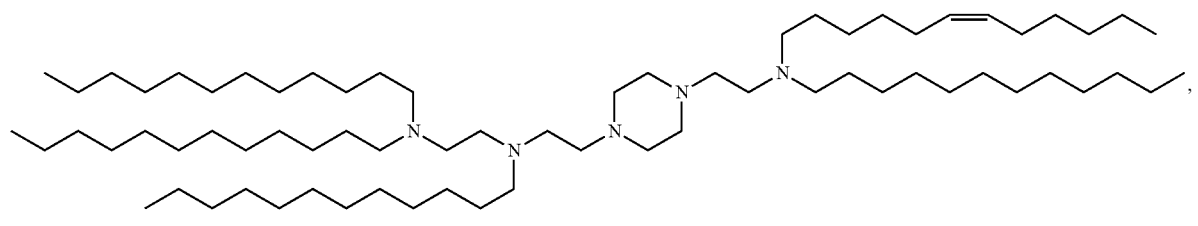
(Compound 257)
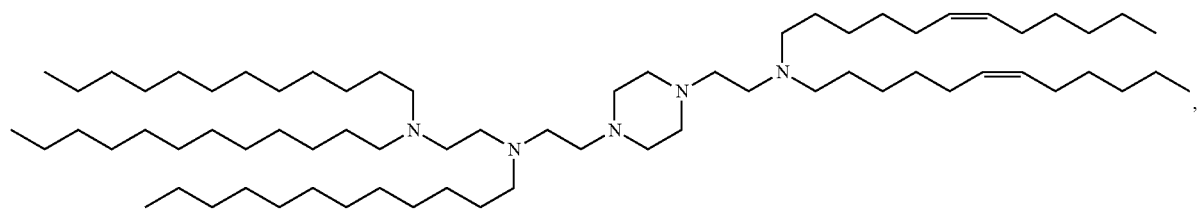
(Compound 258)
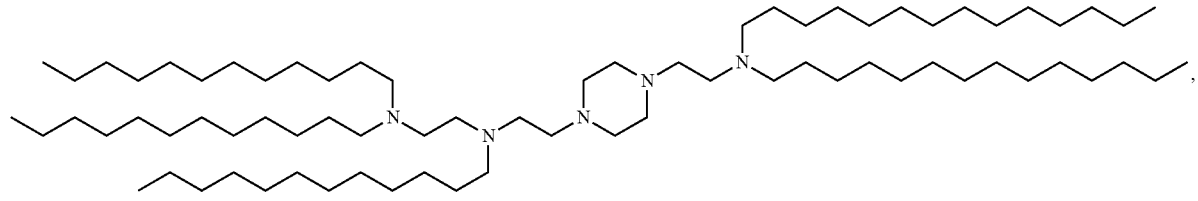
(Compound 259)
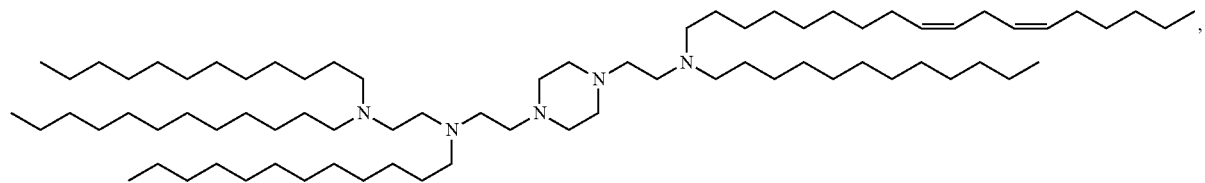
(Compound 260)
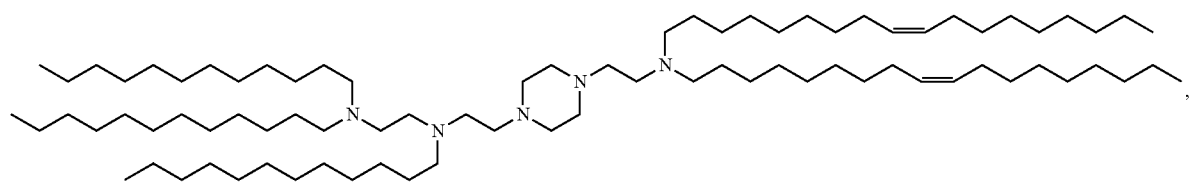
(Compound 261)
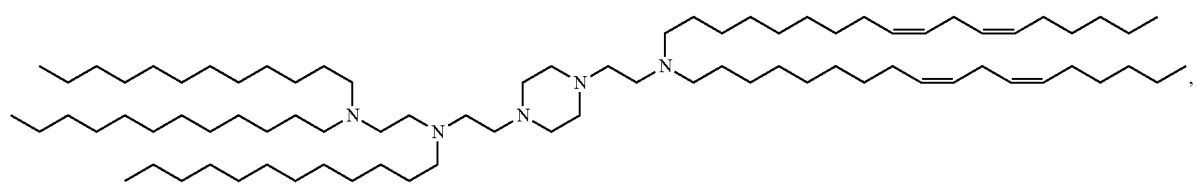

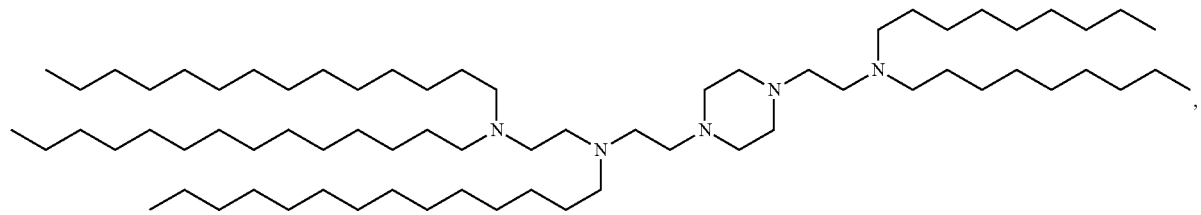
(Compound 262)

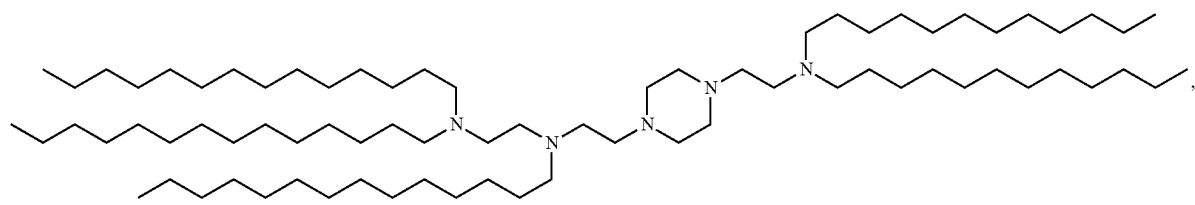
(Compound 263)

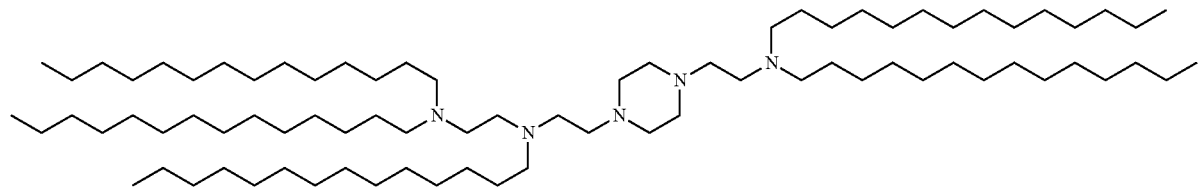
(Compound 264)

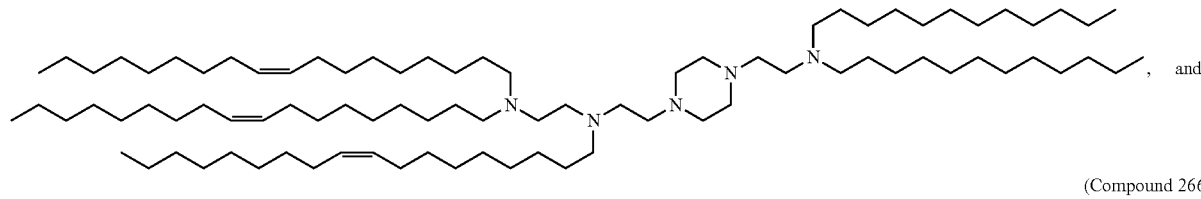
(Compound 265) , and

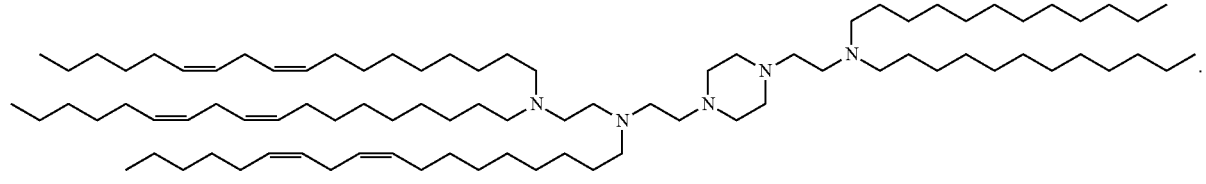
(Compound 266)

In other embodiments, the compound has the Formula (V)

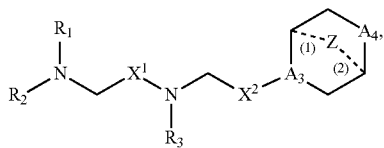
(V)

or a salt or isomer thereof, in which $A_3$ is CH or N;

$A_4$ is $CH_2$ or NH; and at least one of $A_3$ and $A_4$ is N or NH;

Z is $CH_2$ or absent wherein when Z is $CH_2$, the dashed lines (1) and (2) each represent a single bond; and when Z is absent, the dashed lines (1) and (2) are both absent;

$R_1$, $R_2$, and $R_3$ are independently selected from the group consisting of $C_{5-20}$ alkyl, $C_{5-20}$ alkenyl, —R"MR', —R*YR", —YR", and —R*OR";

each M is independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, an aryl group, and a heteroaryl group;

$X^1$ and $X^2$ are independently selected from the group consisting of —CH$_2$—, —(CH$_2$)$_2$—, —CHR—, —CHY—, —C(O)—, —C(O)O—, —OC(O)—, —C(O)—CH$_2$—, —CH$_2$—C(O)—, —C(O)O—CH$_2$—, —OC(O)—CH$_2$—, —CH$_2$—C(O)O—, —CH$_2$—OC(O)—, —CH(OH)—, —C(S)—, and —CH(SH)—;

each Y is independently a $C_{3-6}$ carbocycle;

each R* is independently selected from the group consisting of $C_{1-12}$ alkyl and $C_{2-12}$ alkenyl;

each R is independently selected from the group consisting of $C_{1-3}$ alkyl and a $C_{3-6}$ carbocycle;

each R' is independently selected from the group consisting of $C_{1-12}$ alkyl, $C_{2-12}$ alkenyl, and H; and each R" is independently selected from the group consisting of $C_{3-12}$ alkyl and $C_{3-12}$ alkenyl.

In some embodiments, the compound is of Formula (Va):

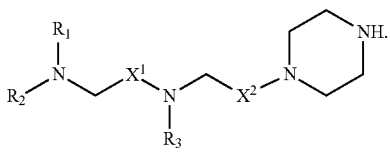

(Va)

The compounds of Formula (V) or (Va) include one or more of the following features when applicable.

In some embodiments, Z is CH2.
In some embodiments, Z is absent.

In some embodiments, at least one of A3 and A4 is N or NH.
In some embodiments, A3 is N and A4 is NH.
In some embodiments, A3 is N and A4 is CH2.
In some embodiments, A3 is CH and A4 is NH.
In some embodiments, at least one of X1 and X2 is not —CH$_2$—. For example, in certain embodiments, X1 is not —CH$_2$—. In some embodiments, at least one of X1 and X2 is —C(O)—.
In some embodiments, X$_2$ is —C(O)—, —C(O)O—, —OC(O)—, —C(O)—CH$_2$—, —CH$_2$—C(O)—, —C(O)O—CH$_2$—, —OC(O)—CH$_2$—, —CH$_2$—C(O)O—, or —CH$_2$—OC(O)—.

In some embodiments, R1, R2, and R3 are independently selected from the group consisting of C5-20 alkyl and C5-20 alkenyl. In some embodiments, R1, R2, and R3 are the same. In certain embodiments, R1, R2, and R3 are C6, C9, C12, or C14 alkyl. In other embodiments, R1, R2, and R3 are C18 alkenyl. For example, R1, R2, and R3 may be linoleyl.

In some embodiments, the compound is selected from the group consisting of:

(Compound 267)

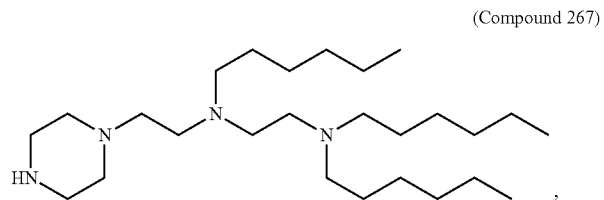

(Compound 268)

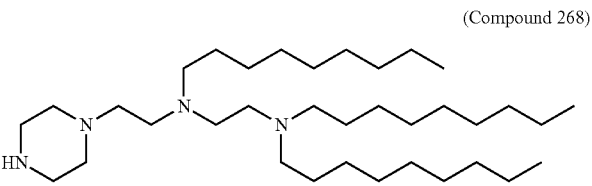

(Compound 269)

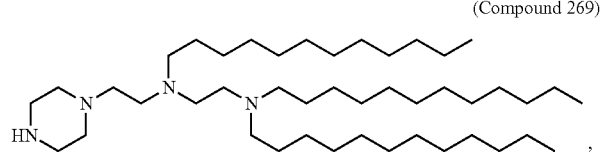

(Compound 270)

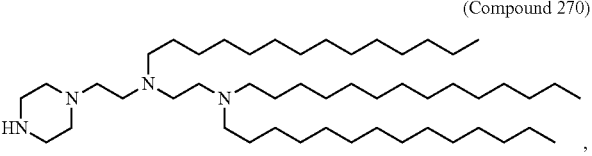

(Compound 271)

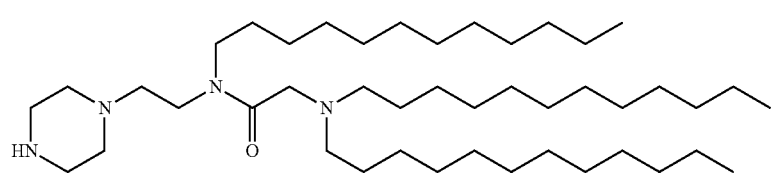

(Compound 272)

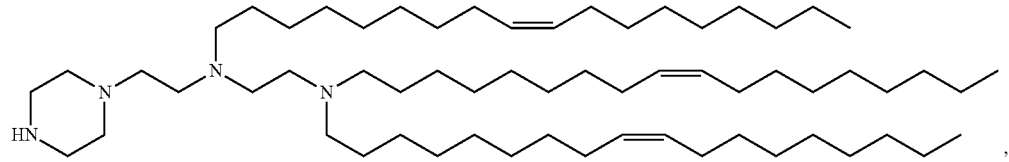

(Compound 273)

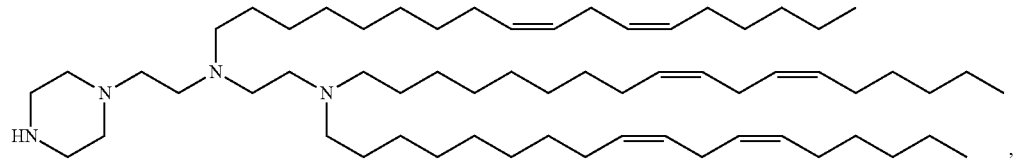

, and (Compound 309)

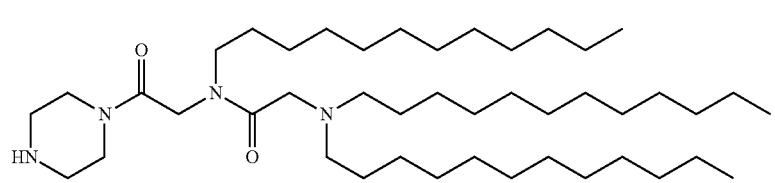

.

In another aspect, the disclosure provides a compound according to Formula (VI):

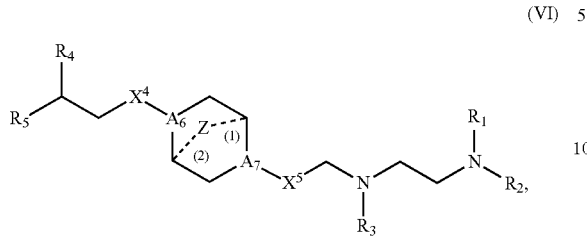

(VI)

or a salt or isomer thereof, in which $A_6$ and $A_7$ are each independently selected from CH or N, wherein at least one of $A_6$ and $A_7$ is N;

Z is $CH_2$ or absent wherein when Z is $CH_2$, the dashed lines (1) and (2) each represent a single bond; and when Z is absent, the dashed lines (1) and (2) are both absent;

$X^4$ and $X^5$ are independently selected from the group consisting of —$CH_2$—, —$(CH_2)_2$—, —CHR—, —CHY—, —C(O)—, —C(O)O—, —OC(O)—, —C(O)—$CH_2$—, —$CH_2$—C(O)—, —C(O)O—$CH_2$—, —OC(O)—$CH_2$—, —$CH_2$—C(O)O—, —$CH_2$—OC(O)—, —CH(OH)—, —C(S)—, and —CH(SH)—;

$R_1$, $R_2$, $R_3$, $R_4$, and $R_5$ each are independently selected from the group consisting of $C_{5-20}$ alkyl, $C_{5-20}$ alkenyl, —R"MR', —R*YR", —YR", and —R*OR";

each M is independently selected from the group consisting of —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)_2—, an aryl group, and a heteroaryl group;

each Y is independently a $C_{3-6}$ carbocycle;

each R* is independently selected from the group consisting of $C_{1-12}$ alkyl and $C_{2-12}$ alkenyl;

each R is independently selected from the group consisting of $C_{1-3}$ alkyl and a $C_{3-6}$ carbocycle;

each R' is independently selected from the group consisting of $C_{1-12}$ alkyl, $C_{2-12}$ alkenyl, and H; and each R" is independently selected from the group consisting of $C_{3-12}$ alkyl and $C_{3-12}$ alkenyl.

In some embodiments, R1, R2, R3, R4, and R5 each are independently selected from the group consisting of C6-20 alkyl and C6-20 alkenyl.

In some embodiments, R1 and R2 are the same. In certain embodiments, R1, R2, and R3 are the same. In some embodiments, R4 and R5 are the same. In certain embodiments, R1, R2, R3, R4, and R5 are the same.

In some embodiments, at least one of R1, R2, R3, R4, and R5 is C9-12 alkyl. In certain embodiments, each of R1, R2, R3, R4, and R5 independently is $C_9$, C12 or C14 alkyl. In certain embodiments, each of R1, R2, R3, R4, and R5 is C9 alkyl.

In some embodiments, A6 is N and A7 is N. In some embodiments, A6 is CH and A7 is N.

In some embodiments, X4 is-$CH_2$— and X5 is —C(O)—. In some embodiments, X4 and X5 are —C(O)—.

In some embodiments, when A6 is N and A7 is N, at least one of X4 and X5 is not —CH2-, e.g., at least one of X4 and X5 is —C(O)—. In some embodiments, when A6 is N and A7 is N, at least one of R1, R2, R3, R4, and R5 is —R"MR'.

In some embodiments, at least one of R1, R2, R3, R4, and R5 is not —R"MR'.

In some embodiments, the compound is (Compound 299)

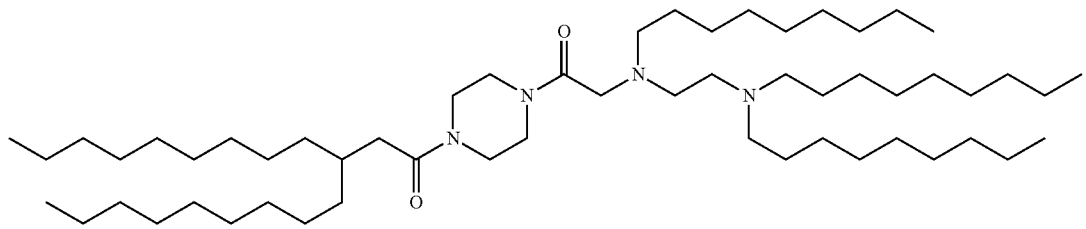

In an embodiment, the compound has the following formula:

(Compound 342)

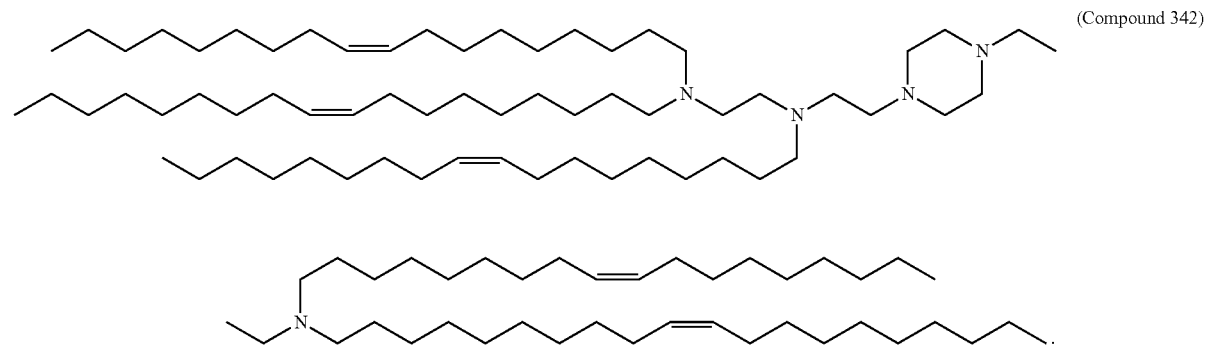

2. PEG and PEG-Modified Lipids

In general, some of the other lipid components (e.g., PEG lipids) of various formulae, described herein may be synthesized as described International Patent Application No. PCT/US2016/000129, filed Dec. 10, 2016, entitled "Compositions and Methods for Delivery of Therapeutic Agents," which is incorporated by reference in its entirety.

The lipid component of a lipid nanoparticle composition may include one or more molecules comprising polyethylene glycol, such as PEG or PEG-modified lipids. Such species may be alternately referred to as PEGylated lipids. A PEG lipid is a lipid modified with polyethylene glycol. A PEG lipid may be selected from the non-limiting group including PEG-modified phosphatidylethanolamines, PEG-modified phosphatidic acids, PEG-modified ceramides, PEG-modified dialkylamines, PEG-modified diacylglycerols, PEG-modified dialkylglycerols, and mixtures thereof. For example, a PEG lipid may be PEG-c-DOMG, PEG-DMG, PEG-DLPE, PEG-DMPE, PEG-DPPC, or a PEG-DSPE lipid.

In some embodiments, the PEG-modified lipids are a modified form of PEG DMG. PEG-DMG has the following structure:

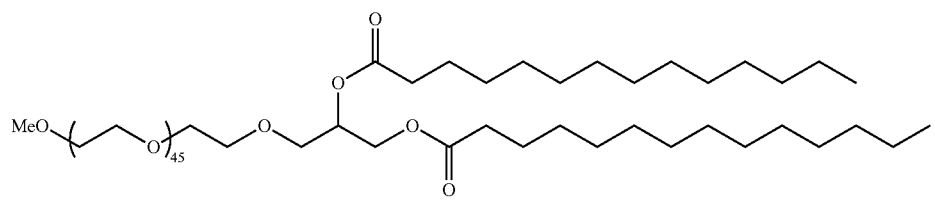

In one embodiment, PEG lipids useful in the present invention can be PEGylated lipids described in International Publication No. WO2012099755, the contents of which is herein incorporated by reference in its entirety. Any of these exemplary PEG lipids described herein may be modified to comprise a hydroxyl group on the PEG chain. In certain embodiments, the PEG lipid is a PEG-OH lipid. As generally defined herein, a "PEG-OH lipid" (also referred to herein as "hydroxy-PEGylated lipid") is a PEGylated lipid having one or more hydroxyl (—OH) groups on the lipid. In certain embodiments, the PEG-OH lipid includes one or more hydroxyl groups on the PEG chain. In certain embodiments, a PEG-OH or hydroxy-PEGylated lipid comprises an —OH group at the terminus of the PEG chain. Each possibility represents a separate embodiment of the present invention.

In certain embodiments, a PEG lipid useful in the present invention is a compound of Formula (VII). Provided herein are compounds of Formula (VII):

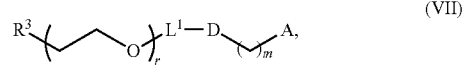
(VII)

or salts thereof, wherein:

$R^3$ is —$OR^O$;

$R^O$ is hydrogen, optionally substituted alkyl, or an oxygen protecting group;

r is an integer between 1 and 100, inclusive;

$L^1$ is optionally substituted $C_{1-10}$ alkylene, wherein at least one methylene of the optionally substituted $C_{1-10}$ alkylene is independently replaced with optionally substituted carbocyclylene, optionally substituted heterocyclylene, optionally substituted arylene, optionally substituted heteroarylene, —O—, —N($R^N$)—, —S—, —C(O)—, —C(O)N($R^N$)—, —$NR^N$C(O)—, —C(O)O—, —OC(O)—, —OC(O)O—, —OC(O)N($R^N$)—, —$NR^N$C(O)O—, or —$NR^N$C(O)N($R^N$)—;

D is a moiety obtained by click chemistry or a moiety cleavable under physiological conditions;

m is 0, 1, 2, 3, 4, 5, 6, 7, 8, 9, or 10;

A is of the formula:

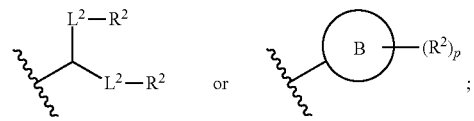

each instance of $L^2$ is independently a bond or optionally substituted $C_{1-6}$ alkylene, wherein one methylene unit of the optionally substituted $C_{1-6}$ alkylene is optionally replaced with —O—, —N($R^N$)—, —S—, —C(O)—, —C(O)N($R^N$)—, —$NR^N$C(O)—, —C(O)O—, —OC(O)—, —OC(O)O—, —OC(O)N($R^N$)—, —$NR^N$C(O)O—, or —$NR^N$C(O)N($R^N$)—;

each instance of $R^2$ is independently optionally substituted $C_{1-30}$ alkyl, optionally substituted $C_{1-30}$ alkenyl, or optionally substituted $C_{1-30}$ alkynyl; optionally wherein one or more methylene units of $R^2$ are independently replaced with optionally substituted carbocyclylene, optionally substituted heterocyclylene, optionally substituted arylene, optionally substituted heteroarylene, —N($R^N$)—, —O—, —S—, —C(O)—, —C(O)N($R^N$)—, —$NR^N$C(O)—, —$NR^N$C(O)N($R^N$)—, —C(O)O—, —OC(O)—, —OC(O)O—, —OC(O)N($R^N$)—, —$NR^N$C(O)O—, —C(O)S—, —SC(O)—, —C(=$NR^N$)—, —C(=$NR^N$)N($R^N$)—, —$NR^N$C(=$NR^N$)—, —$NR^N$C(=$NR^N$)N($R^N$)—, —C(S)—, —C(S)N($R^N$)—, —$NR^N$C(S)—, —$NR^N$C(S)N($R^N$)—, —S(O)—, —OS(O)—, —S(O)O—, —OS(O)O—, —OS(O)$_2$—, —S(O)$_2$O—, —OS(O)$_{20}$—, —N($R^N$)S(O)—, —S(O)N($R^N$)—, —N($R^N$)S(O)N($R^N$)—, —OS(O)N($R^N$)—, —N($R^N$)S(O)O—, —S(O)$_2$—, —N($R^N$)S(O)$_2$—, —S(O)$_2$N($R^N$)—, —N($R^N$)S(O)$_2$N($R^N$)—, —OS(O)$_2$N($R^N$)—, or —N($R^N$)S(O)$_2$O—;

each instance of $R^N$ is independently hydrogen, optionally substituted alkyl, or a nitrogen protecting group;

Ring B is optionally substituted carbocyclyl, optionally substituted heterocyclyl, optionally substituted aryl, or optionally substituted heteroaryl; and p is 1 or 2.

In certain embodiments, the compound of Formula (VII) is a PEG-OH lipid (i.e., $R^3$ is —$OR^O$, and $R^O$ is hydrogen). In certain embodiments, the compound of Formula (VII) is of Formula (VII-OH):

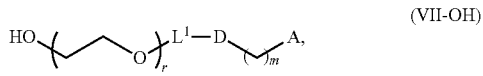

or a salt thereof.

In certain embodiments, D is a moiety obtained by click chemistry (e.g., triazole). In certain embodiments, the compound of Formula (VII) is of Formula (VII-a-1) or (VII-a-2):

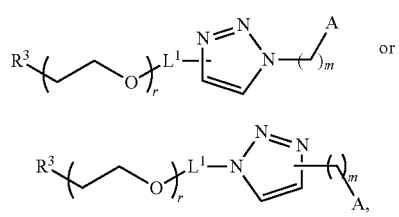

or a salt thereof.

In certain embodiments, the compound of Formula (VII) is of one of the following formulae:

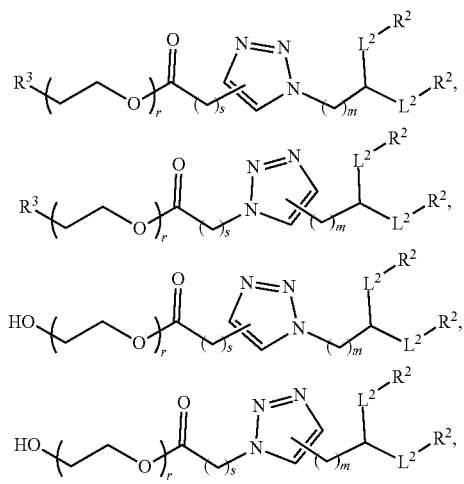

or a salt thereof, wherein
s is 0, 1, 2, 3, 4, 5, 6, 7, 8, 9, or 10.

In certain embodiments, the compound of Formula (VII) is of one of the following formulae:

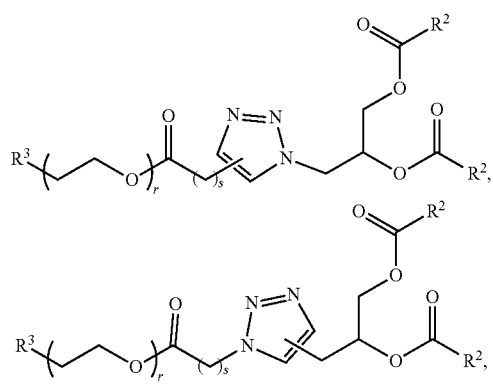

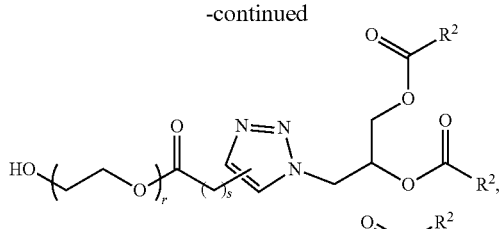

or a salt thereof.

In certain embodiments, a compound of Formula (VII) is of one of the following formulae:

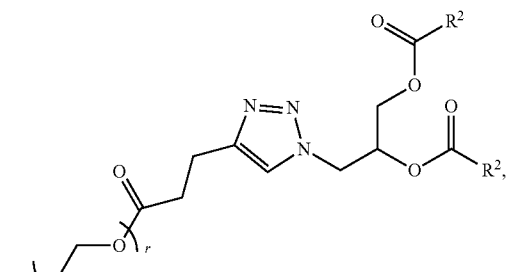
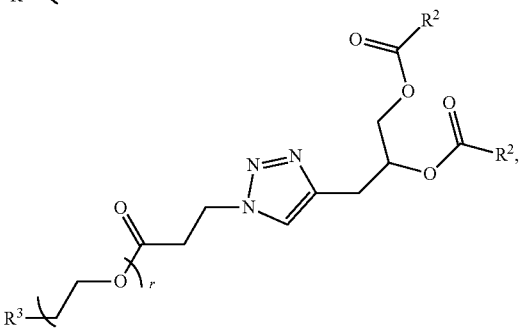
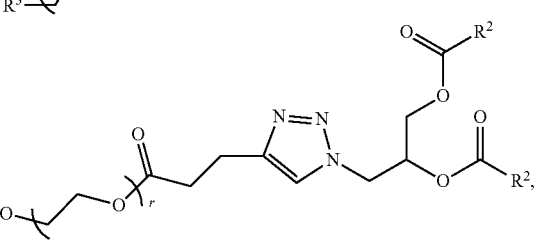
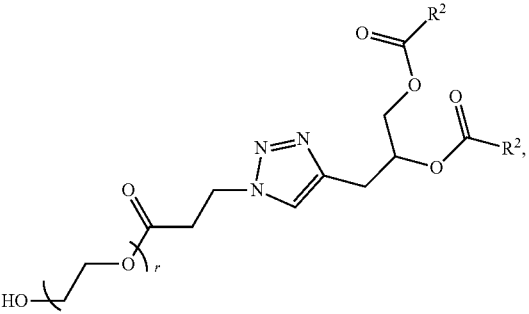

or a salt thereof.

In certain embodiments, a compound of Formula (VII) is of one of the following formulae, wherein r is 1-100:

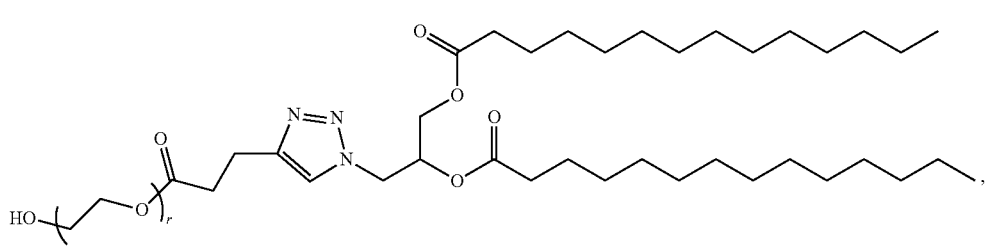
(Compound 415)

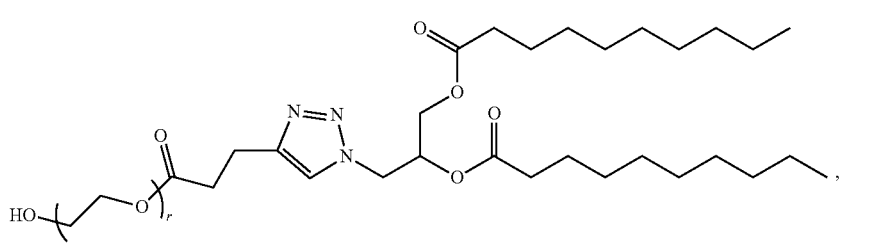
(Compound 416)

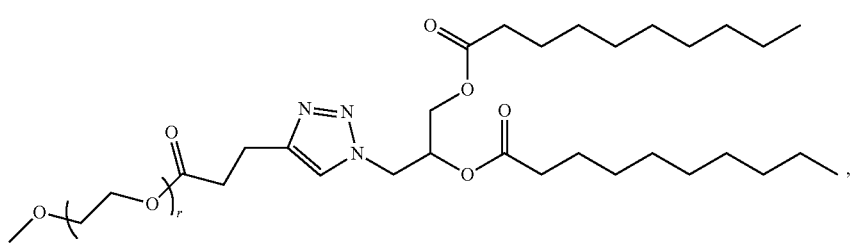
(Compound 417)

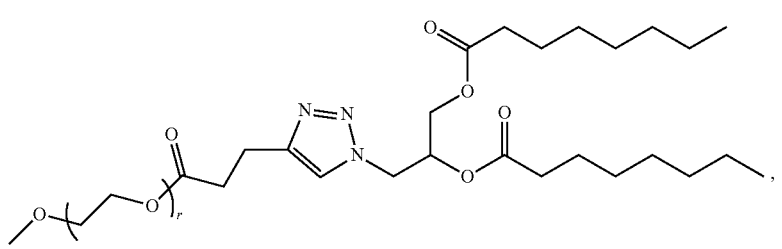
(Compound 418)

or a salt thereof.

In certain embodiments, D is a moiety cleavable under physiological conditions (e.g., ester, amide, carbonate, carbamate, urea). In certain embodiments, a compound of Formula (VII) is of Formula (VII-b-1) or (VII-b-2):

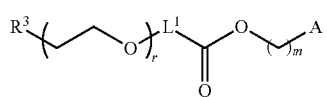
(VII-b-1)

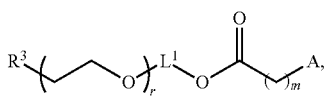
(VII-b-2)

or a salt thereof.

In certain embodiments, a compound of Formula (VII) is of Formula (VII-b-1-OH) or (VII-b-2-OH):

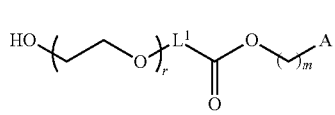
(VII-b-1-OH)

(VII-b-2-OH)

or a salt thereof.

In certain embodiments, the compound of Formula (VII) is of one of the following formulae:

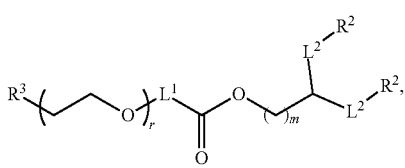

255
-continued
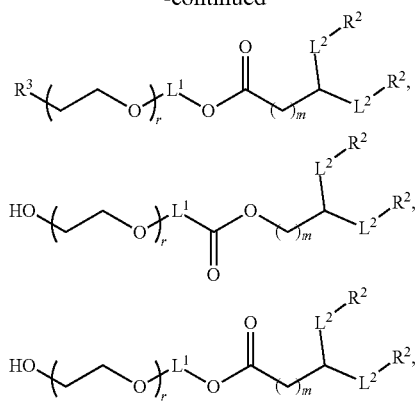
or a salt thereof.
In certain embodiments, a compound of Formula (VII) is of one of the following formulae:
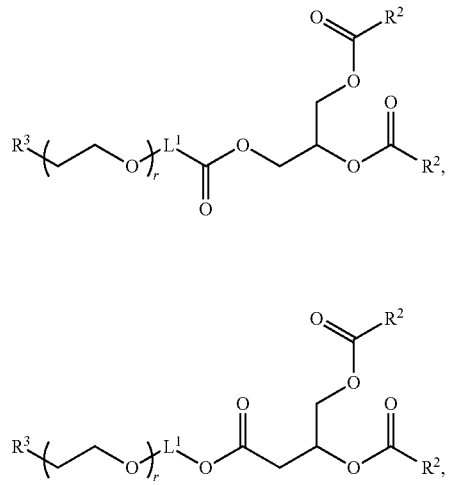
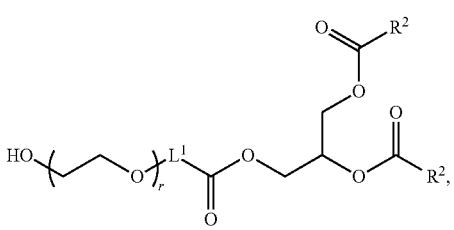
256
-continued
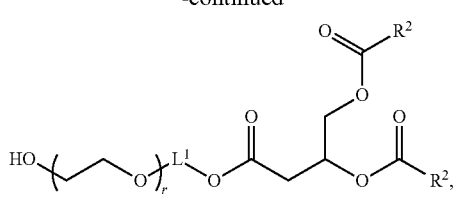
or a salt thereof.
In certain embodiments, a compound of Formula (VII) is of one of the following formulae:
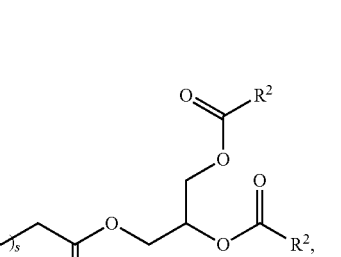
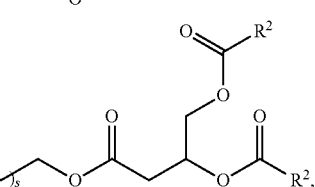
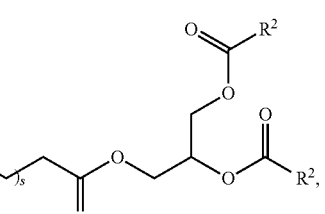
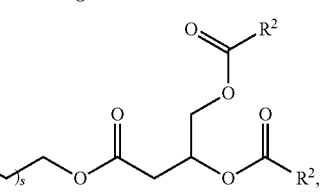
or a salt thereof.
In certain embodiments, a compound of Formula (VII) is of one of the following formulae:
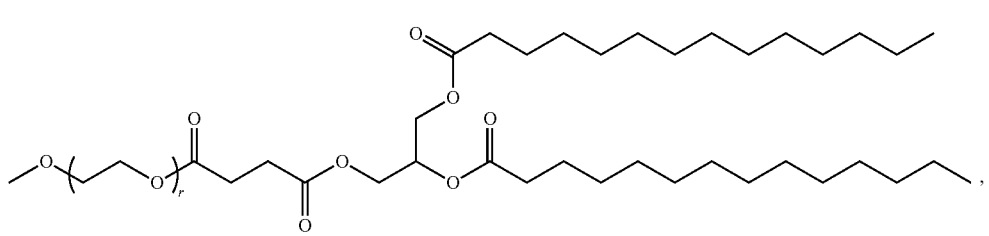
(Compound 430)

(Compound 431)

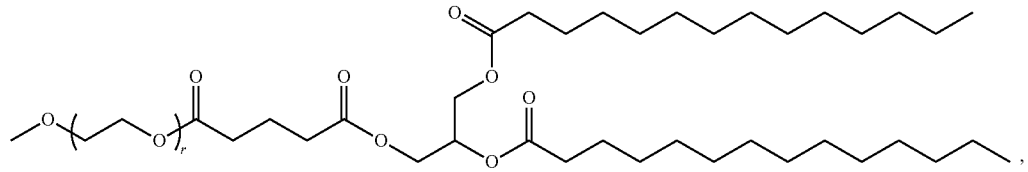

or salts thereof.

In certain embodiments, a PEG lipid useful in the present invention is a PEGylated fatty acid. In certain embodiments, a PEG lipid useful in the present invention is a compound of Formula (VIII). Provided herein are compounds of Formula (VIII):

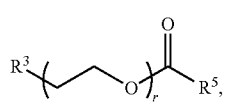
(VIII)

or a salts thereof, wherein:

$R^3$ is-$OR^O$;

$R^O$ is hydrogen, optionally substituted alkyl or an oxygen protecting group;

r is an integer between 1 and 100, inclusive;

$R^5$ is optionally substituted $C_{10-40}$ alkyl, optionally substituted $C_{10-40}$ alkenyl, or optionally substituted $C_{10-40}$ alkynyl; and optionally one or more methylene groups of $R^5$ are replaced with optionally substituted carbocyclylene, optionally substituted heterocyclylene, optionally substituted arylene, optionally substituted heteroarylene, —N($R^N$)—, —O—, —S—, —C(O)—, —C(O)N($R^N$)—, —N$R^N$C(O)—, —N$R^N$C(O)N($R^N$)—, —C(O)O—, —OC(O)—, —OC(O)O—, —OC(O)N($R^N$)—, —N$R^N$C(O)O—, —C(O)S—, —SC(O)—, —C(=N$R^N$)—, —C(=N$R^N$)N($R^N$)—, —N$R^N$C(=N$R^N$)—, —N$R^N$C(=N$R^N$)N($R^N$)—, —C(S)—, —C(S)N($R^N$)—, —N$R^N$C(S)—, —N$R^N$C(S)N($R^N$)—, —S(O)—, —OS(O)—, —S(O)O—, —OS(O)O—, —OS(O)$_2$—, —S(O)$_2$O—, —OS(O)$_2$O—, —N($R^N$)S(O)—, —S(O)N($R^N$)—, —N($R^N$)S(O)N($R^N$)—, —OS(O)N($R^N$)—, —N($R^N$)S(O)O—, —S(O)$_2$—, —N($R^N$)S(O)$_2$—, —S(O)$_2$N($R^N$)—, —N($R^N$)S(O)$_2$N($R^N$)—, —OS(O)$_2$N($R^N$)—, or —N($R^N$)S(O)$_2$O—; and each instance of $R^N$ is independently hydrogen, optionally substituted alkyl, or a nitrogen protecting group.

In certain embodiments, the compound of Formula (VIII) is of Formula (VIII-OH):

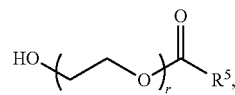
(VIII-OH)

or a salt thereof.

In certain embodiments, a compound of Formula (VIII) is of one of the following formulae:

(Compound 419)
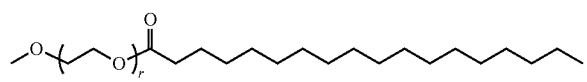

(Compound 420)
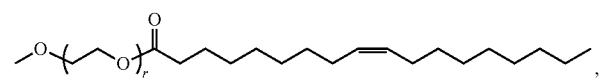

(Compound 421)
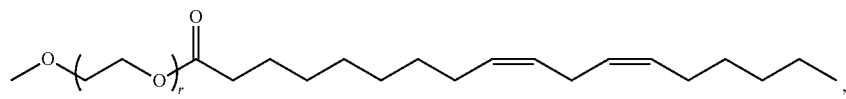

(Compound 422)
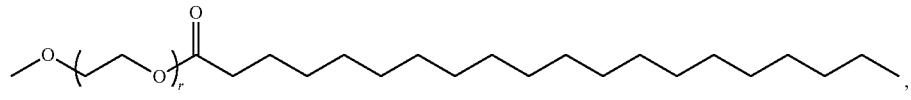

(Compound 423)
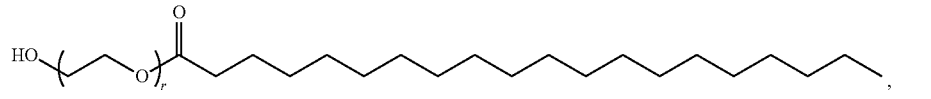

(Compound 424)
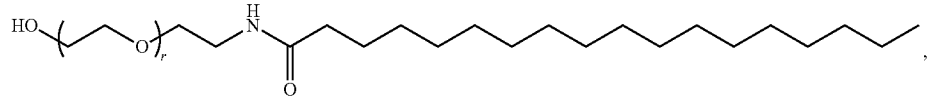

(Compound 425)

HO$\left(\begin{array}{c}\\O\end{array}\right)_r$O~~~~~~~~~~~~~~~~ or a salt thereof. In some embodiments, r is 45.

In yet other embodiments the compound of Formula (VIII) is:

(Compound 427)

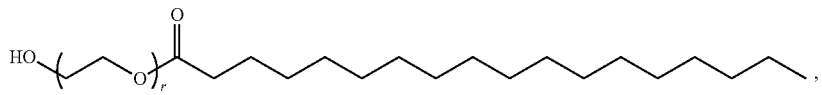

or a salt thereof.

In some embodiments, the compound of Formula (VIII) is (Compound 427)

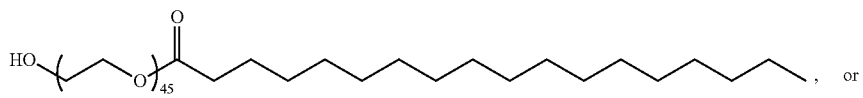, or (Compound 403)

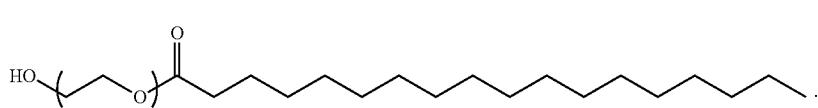.

3. Phospholipids

Phospholipids, as defined herein, are any lipids that comprise a phosphate group. Phospholipids are a subset of non-cationic lipids. The lipid component of a lipid nanoparticle composition may include one or more phospholipids, such as one or more (poly)unsaturated lipids. Phospholipids may assemble into one or more lipid bilayers. In general, phospholipids may include a phospholipid moiety and one or more fatty acid moieties. A phospholipid moiety may be selected from the non-limiting group consisting of phosphatidyl choline, phosphatidyl ethanolamine, phosphatidyl glycerol, phosphatidyl serine, phosphatidic acid, 2-lysophosphatidyl choline, and a sphingomyelin. A fatty acid moiety may be selected from the non-limiting group consisting of lauric acid, myristic acid, myristoleic acid, palmitic acid, palmitoleic acid, stearic acid, oleic acid, linoleic acid, alpha-linolenic acid, erucic acid, phytanoic acid, arachidic acid, arachidonic acid, eicosapentaenoic acid, behenic acid, docosapentaenoic acid, and docosahexaenoic acid. Non-natural species including natural species with modifications and substitutions including branching, oxidation, cyclization, and alkynes are also contemplated. For example, a phospholipid may be functionalized with or cross-linked to one or more alkynes (e.g., an alkenyl group in which one or more double bonds is replaced with a triple bond). Under appropriate reaction conditions, an alkyne group may undergo a copper-catalyzed cycloaddition upon exposure to an azide. Such reactions may be useful in functionalizing a lipid bilayer of a nanoparticle composition to facilitate membrane permeation or cellular recognition or in conjugating a nanoparticle composition to a useful component such as a targeting or imaging moiety (e.g., a dye).

Phospholipids useful or potentially useful in the compositions and methods may be selected from the non-limiting group consisting of 1,2-distearoyl-sn-glycero-3-phosphocholine (DSPC),
1,2-dioleoyl-sn-glycero-3-phosphoethanolamine (DOPE),
1,2-dilinoleoyl-sn-glycero-3-phosphocholine (DLPC),
1,2-dimyristoyl-sn-glycero-phosphocholine (DMPC), 1,2-dioleoyl-sn-glycero-3-phosphocholine (DOPC), 1,2-dipalmitoyl-sn-glycero-3-phosphocholine (DPPC),
1,2-diundecanoyl-sn-glycero-phosphocholine (DUPC),
1-palmitoyl-2-oleoyl-sn-glycero-3-phosphocholine (POPC),
1,2-di-O-octadecenyl-sn-glycero-3-phosphocholine (18:0 Diether PC),
1-oleoyl-2-cholesterylhemisuccinoyl-sn-glycero-3-phosphocholine (OChemsPC),
1-hexadecyl-sn-glycero-3-phosphocholine (C16 Lyso PC),
1,2-dilinolenoyl-sn-glycero-3-phosphocholine, 1,2-diarachidonoyl-sn-glycero-3-phosphocholine,
1,2-didocosahexaenoyl-sn-glycero-3-phosphocholine,
1,2-diphytanoyl-sn-glycero-3-phosphoethanolamine (ME 16.0 PE),
1,2-distearoyl-sn-glycero-3-phosphoethanolamine,
1,2-dilinoleoyl-sn-glycero-3-phosphoethanolamine,
1,2-dilinolenoyl-sn-glycero-3-phosphoethanolamine,
1,2-diarachidonoyl-sn-glycero-3-phosphoethanolamine,
1,2-didocosahexaenoyl-sn-glycero-3-phosphoethanolamine,
1,2-dioleoyl-sn-glycero-3-phospho-rac-(1-glycerol) sodium salt (DOPG), and sphingomyelin.

Each possibility represents a separate embodiment of the present invention.

In some embodiments, a lipid nanoparticle composition includes DSPC. In certain embodiments, a lipid nanoparticle composition includes DOPE. In some embodiments, a lipid nanoparticle composition includes both DSPC and DOPE. Examples of phospholipids include, but are not limited to, the following:

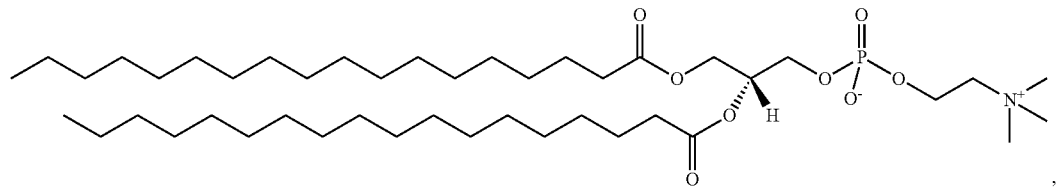
(Compound 432)
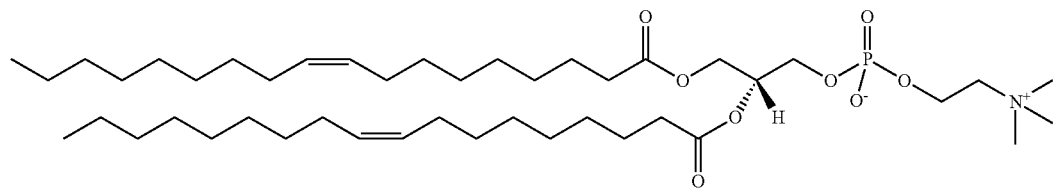
(Compound 433)
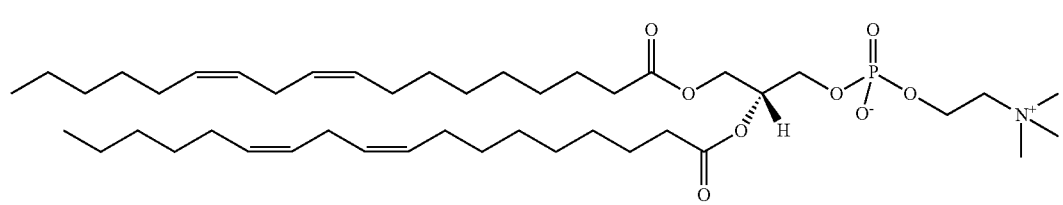
(Compound 434)
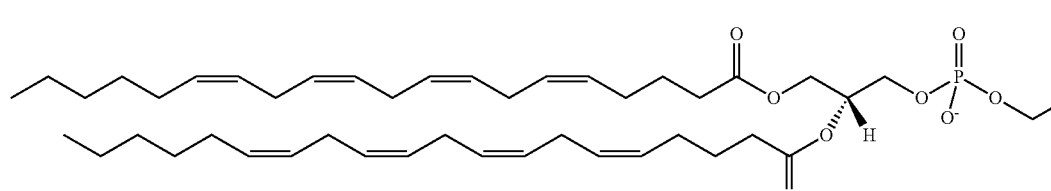
(Compound 435)
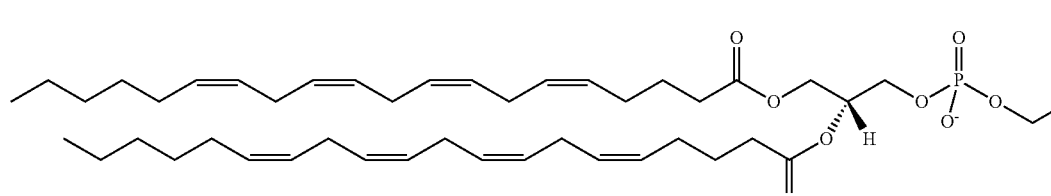
(Compound 436)
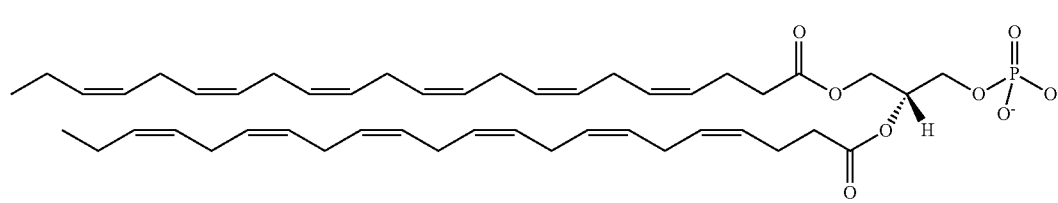
(Compound 437)
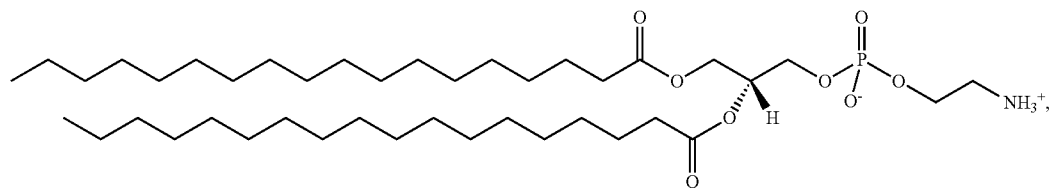
(Compound 438)

-continued
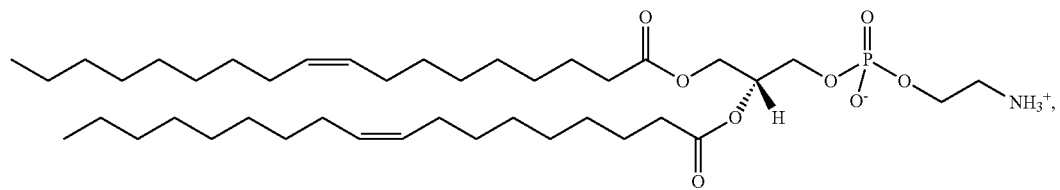
(Compound 439)
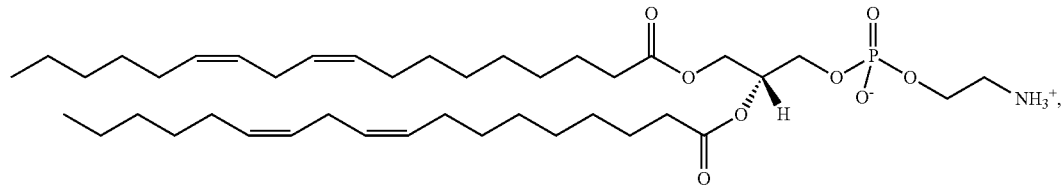
(Compound 440)
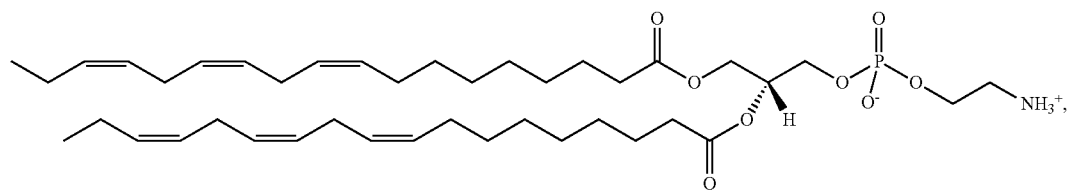
(Compound 441)
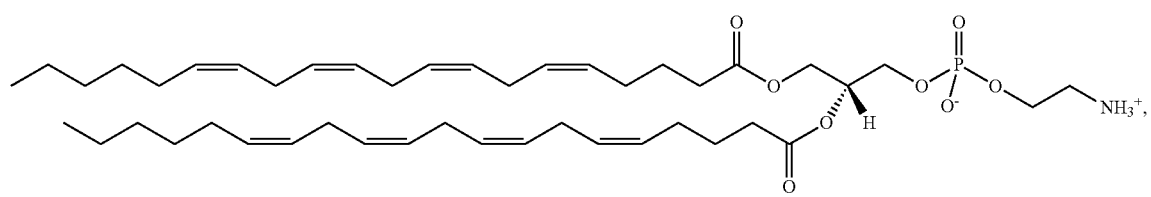
(Compound 442)
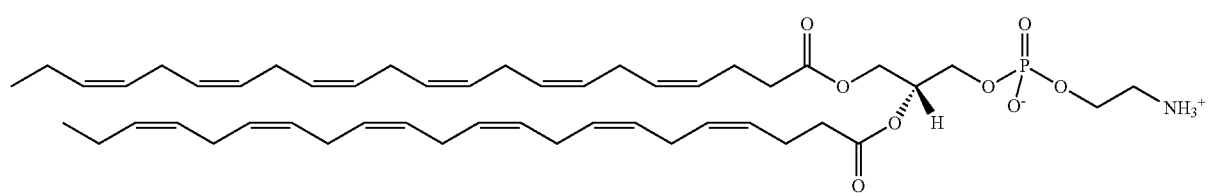
(Compound 443)
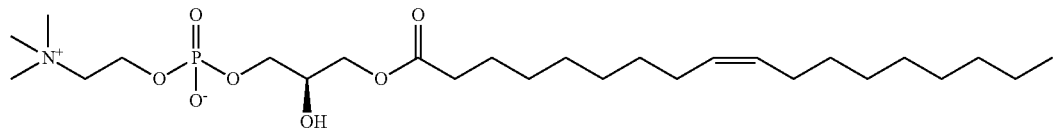
(Compound 444)
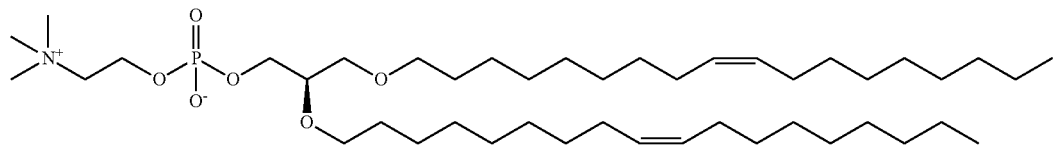
(Compound 445)
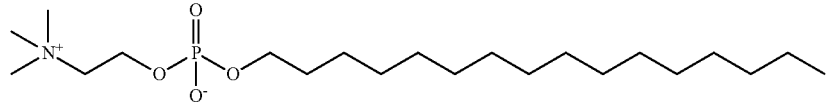
(Compound 446)
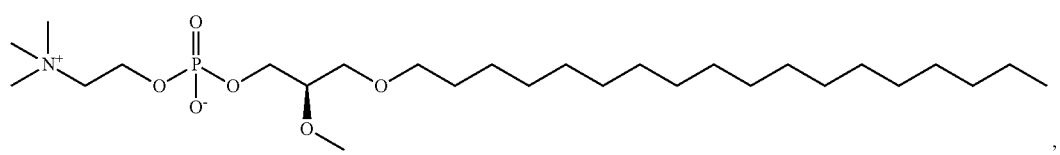
(Compound 447)
, and (Compound 448)

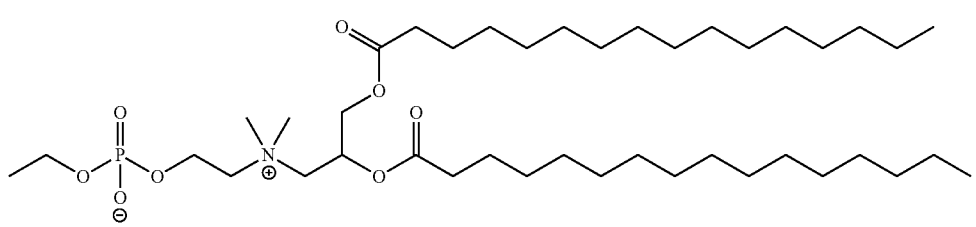

In certain embodiments, a phospholipid useful or potentially useful in the present invention is an analog or variant of DSPC. In certain embodiments, a phospholipid useful or potentially useful in the present invention is a compound of Formula (IX):

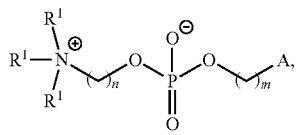

(IX)

or a salt thereof, wherein:

each $R^1$ is independently optionally substituted alkyl; or optionally two $R^1$ are joined together with the intervening atoms to form optionally substituted monocyclic carbocyclyl or optionally substituted monocyclic heterocyclyl; or optionally three $R^1$ are joined together with the intervening atoms to form optionally substituted bicyclic carbocyclyl or optionally substitute bicyclic heterocyclyl;

n is 1, 2, 3, 4, 5, 6, 7, 8, 9, or 10;

m is 0, 1, 2, 3, 4, 5, 6, 7, 8, 9, or 10;

A is of the formula:

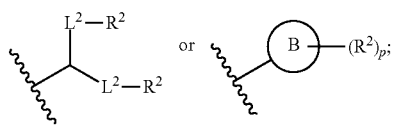

each instance of $L^2$ is independently a bond or optionally substituted $C_{1-6}$ alkylene, wherein one methylene unit of the optionally substituted $C_{1-6}$ alkylene is optionally replaced with —O—, —N($R^N$)—, -S—, —C(O)—, —C(O)N($R^N$)—, —NR$^N$C(O)—, —C(O)O—, —OC(O)—, —OC(O)O—, —OC(O)N($R^N$)—, —NR$^N$C(O)O—, or —NR$^N$C(O)N($R^N$)—;

each instance of $R^2$ is independently optionally substituted $C_{1-30}$ alkyl, optionally substituted $C_{1-30}$ alkenyl, or optionally substituted $C_{1-30}$ alkynyl; optionally wherein one or more methylene units of $R^2$ are independently replaced with optionally substituted carbocyclylene, optionally substituted heterocyclylene, optionally substituted arylene, optionally substituted heteroarylene, —N($R^N$)—, —O—, —S—, —C(O)—, —C(O)N($R^N$)—, —NR$^N$C(O)—, —NR$^N$C(O)N($R^N$)—, —C(O)O—, —OC(O)—, —OC(O)O—, —OC(O)N($R^N$)—, —NR$^N$C(O)O—, —C(O)S—, —SC(O)—, —C(=NR$^N$)—, —C(=NR$^N$)N($R^N$)—, —NR$^N$C(=NR$^N$)—, —NR$^N$C(=NR$^N$)N($R^N$)—, —C(S)—, —C(S)N($R^N$)—, —NR$^N$C(S)—, —NR$^N$C(S)N($R^N$)—, —S(O)—, —OS(O)—, —S(O)O—, —OS(O)O—, —OS(O)$_2$—, —S(O)$_2$O—, —OS(O)$_2$O—, —N($R^N$)S(O)—, —S(O)N($R^N$)—, —N($R^N$)S(O)N($R^N$)—, —OS(O)N($R^N$)—, —N($R^N$)S(O)O—, —S(O)$_2$—, —N($R^N$)S(O)$_2$—, —S(O)$_2$N($R^N$)—, —N($R^N$)S(O)$_2$N($R^N$)—, —OS(O)$_2$N($R^N$)—, or —N($R^N$)S(O)$_2$O—;

each instance of $R^N$ is independently hydrogen, optionally substituted alkyl, or a nitrogen protecting group;

Ring B is optionally substituted carbocyclyl, optionally substituted heterocyclyl, optionally substituted aryl, or optionally substituted heteroaryl; and p is 1 or 2;

provided that the compound is not of the formula:

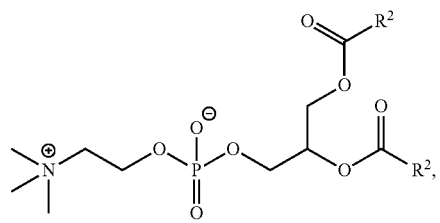

wherein each instance of $R^2$ is independently unsubstituted alkyl, unsubstituted alkenyl, or unsubstituted alkynyl.

Phospholipid Head Modifications

In certain embodiments, a phospholipid useful or potentially useful in the present invention comprises a modified phospholipid head (e.g., a modified choline group). In certain embodiments, a phospholipid with a modified head is DSPC, or analog thereof, with a modified quaternary amine. For example, in embodiments of Formula (IX), at least one of $R^1$ is not methyl. In certain embodiments, at least one of $R^1$ is not hydrogen or methyl. In certain embodiments, the compound of Formula (IX) is of one of the following formulae:

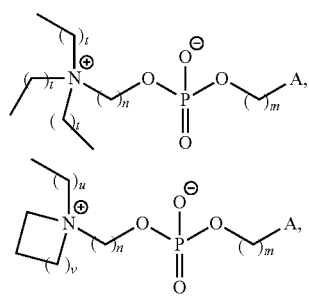

-continued
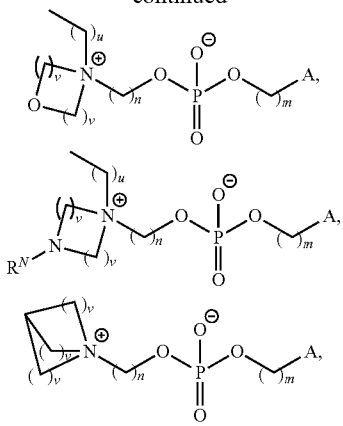
or a salt thereof, wherein:
each t is independently 1, 2, 3, 4, 5, 6, 7, 8, 9, or 10;
each u is independently 0, 1, 2, 3, 4, 5, 6, 7, 8, 9, or 10; and
each v is independently 1, 2, or 3.
In certain embodiments, the compound of Formula (IX) is of one of the following formulae:
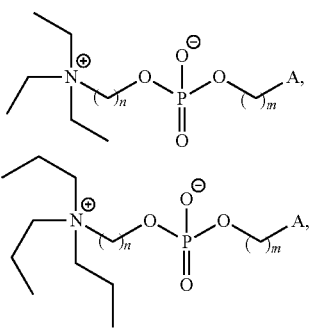
-continued
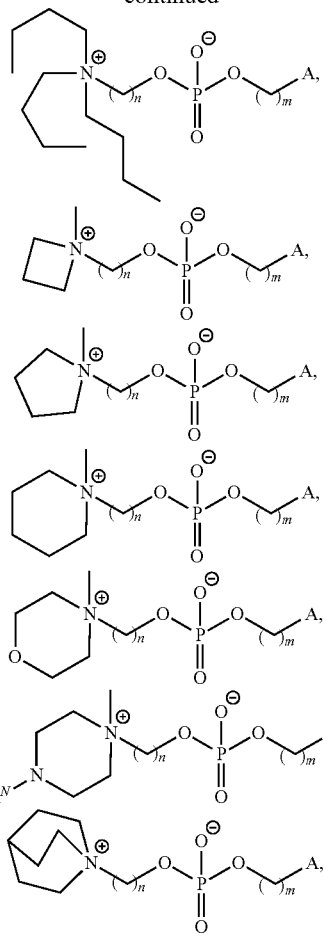
or a salt thereof.
In certain embodiments, a compound of Formula (IX) is one of the following:
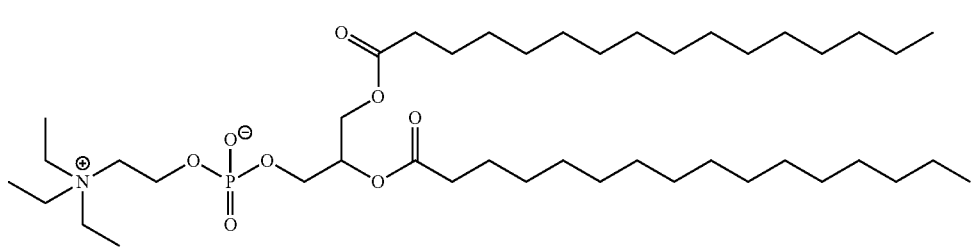
(Compound 400)
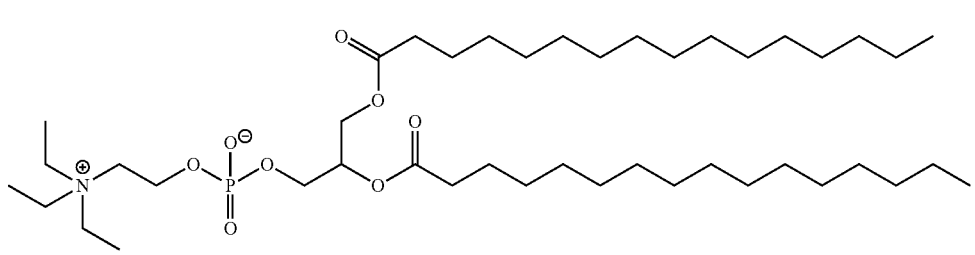
(Compound 401)

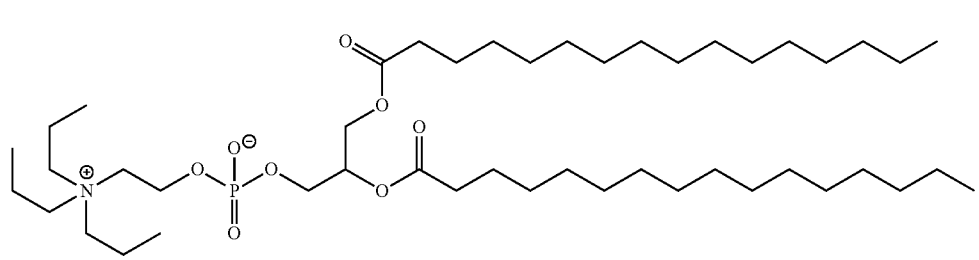
(Compound 402)
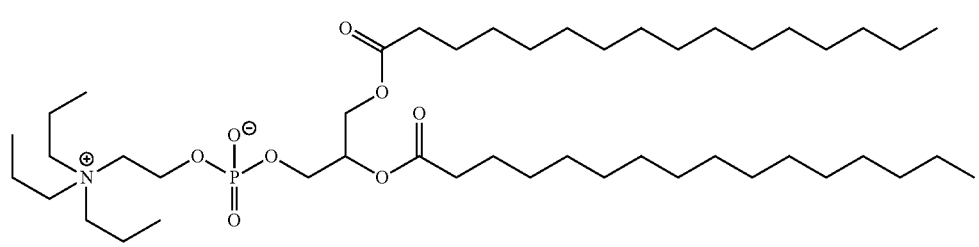
(Compound 403)
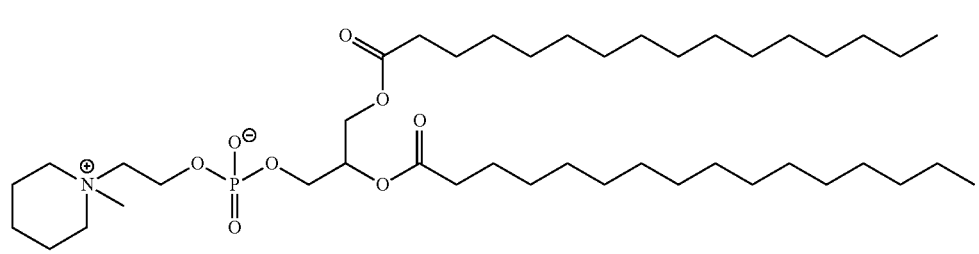
(Compound 404)
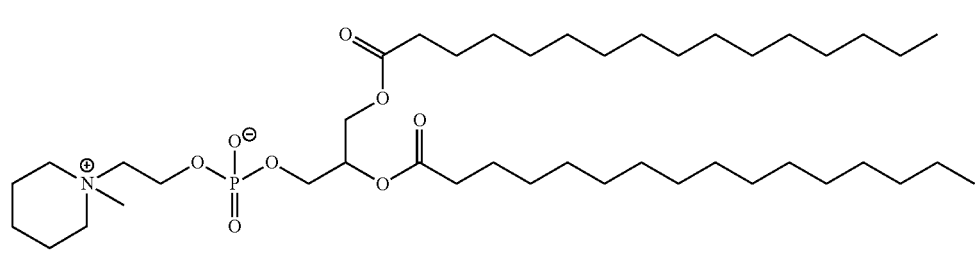
(Compound 405)
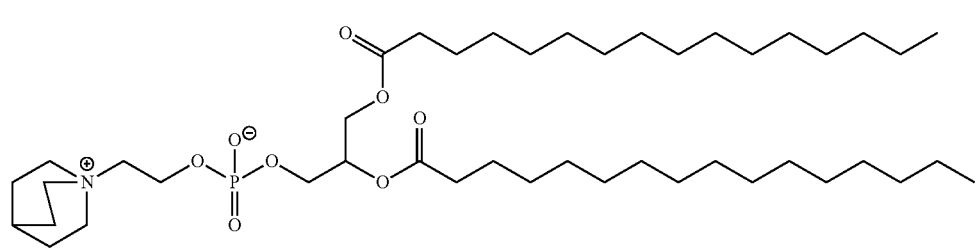
(Compound 406)
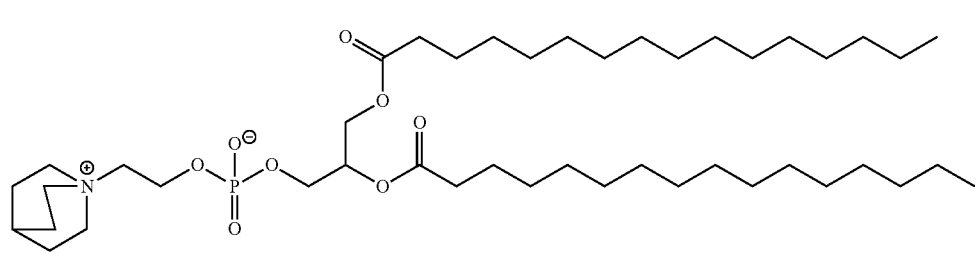
(Compound 407)

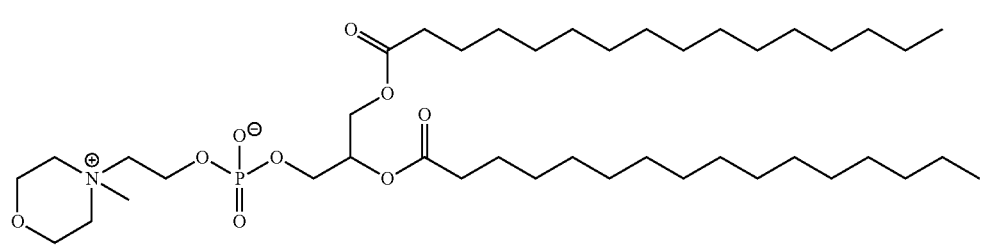
(Compound 408)

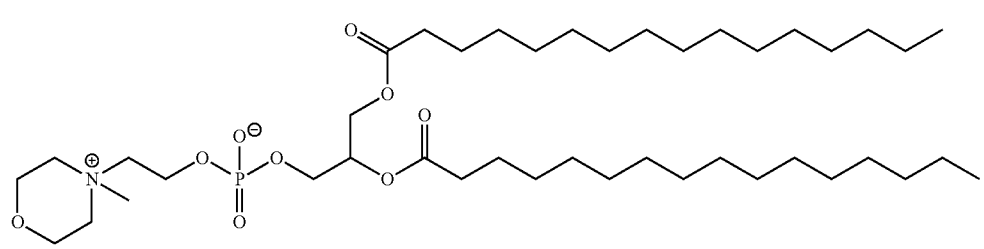
(Compound 409)

or a salt thereof.

In certain embodiments, a compound of Formula (IX) is of Formula (IX-a):

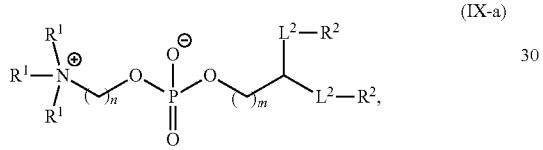
(IX-a)

or a salt thereof.

In certain embodiments, phospholipids useful or potentially useful in the present invention comprise a modified core. In certain embodiments, a phospholipid with a modified core described herein is DSPC, or analog thereof, with a modified core structure. For example, in certain embodiments of Formula (IX-a), group A is not of the following formula:

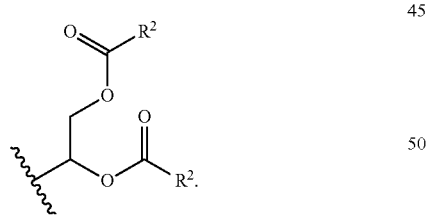

In certain embodiments, the compound of Formula (IX-b-4) is of one of the following formulae:

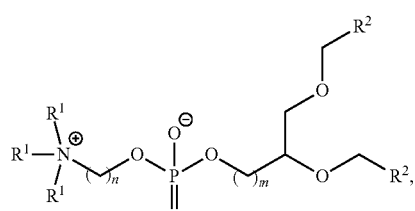

-continued

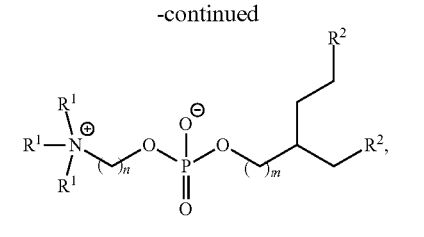

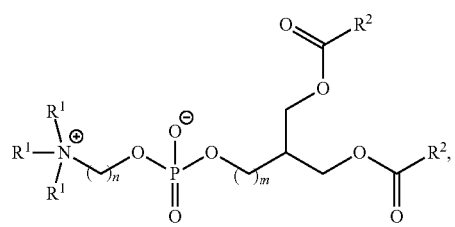

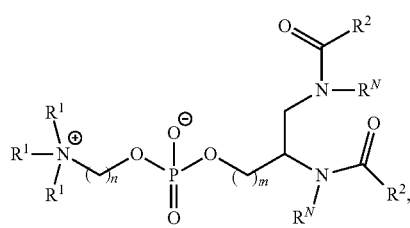

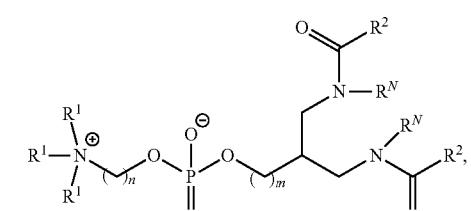

or a salt thereof.

In certain embodiments, a compound of Formula (IX) is one of the following:

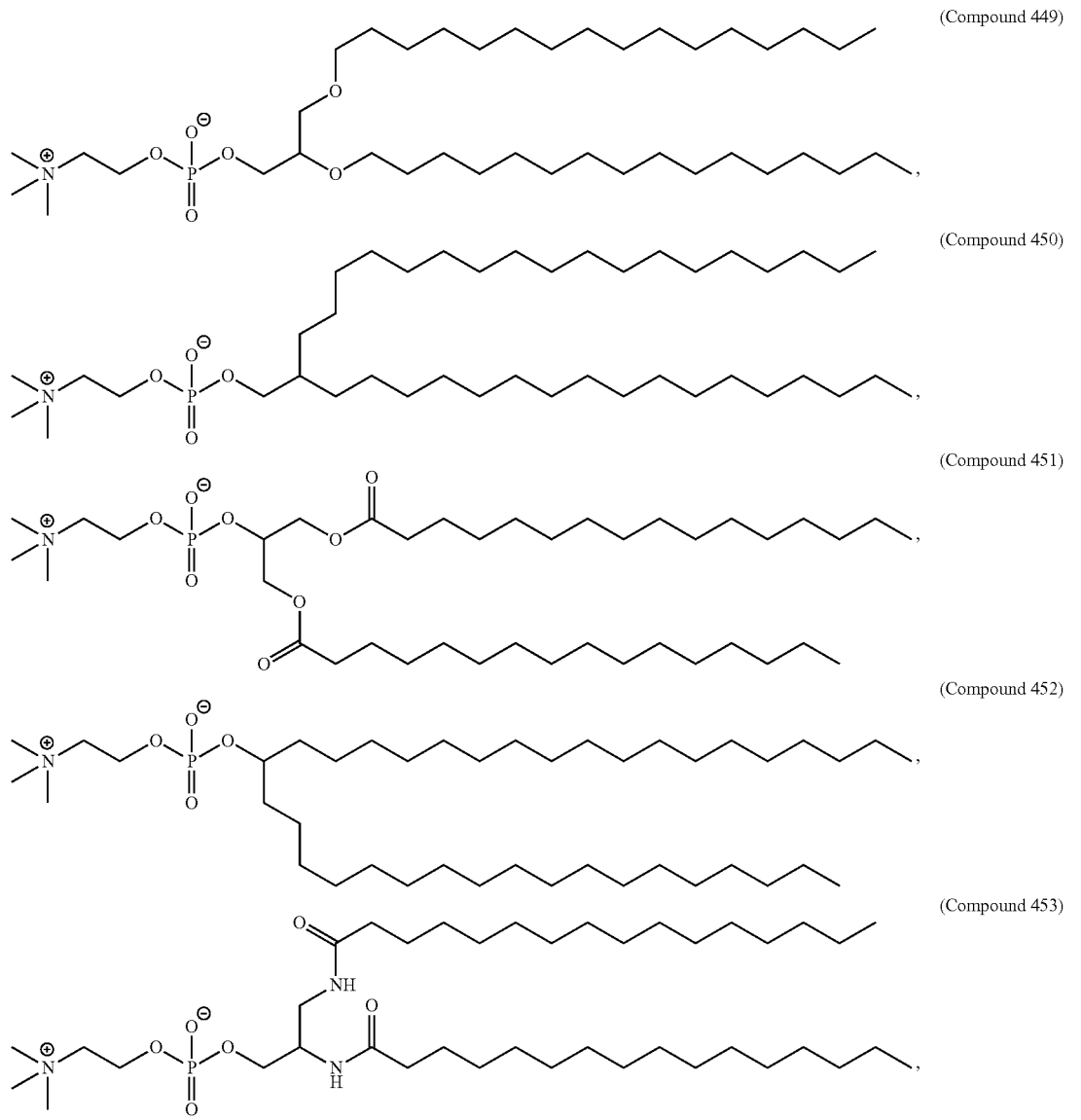

(Compound 449)

(Compound 450)

(Compound 451)

(Compound 452)

(Compound 453)

or salts thereof.

In certain embodiments, a phospholipid useful or potentially useful in the present invention comprises a cyclic moiety in place of the glyceride moiety. In certain embodiments, a phospholipid useful in the present invention is DSPC, or analog thereof, with a cyclic moiety in place of the glyceride moiety. In certain embodiments, the compound of Formula (IX) is of Formula (IX-b):

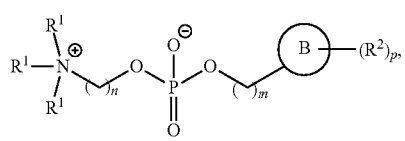

(IX-b)

or a salt thereof.

In certain embodiments, the compound of Formula (IX-b) is of Formula (IX-b-1):

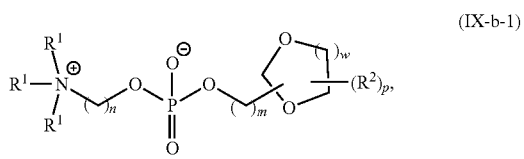

(IX-b-1)

or a salt thereof, wherein:

w is 0, 1, 2, or 3.

In certain embodiments, the compound of Formula (IX-b) is of Formula (IX-b-2):

(IX-b-2)

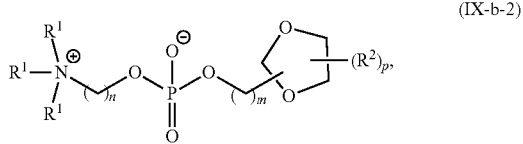

or a salt thereof.

In certain embodiments, the compound of Formula (IX-b) is of Formula (IX-b-3):

(IX-b-3)

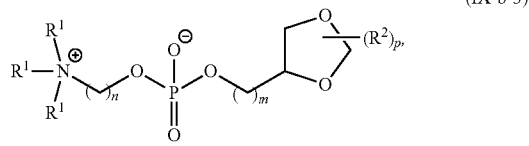

or a salt thereof.

In certain embodiments, the compound of Formula (I-b) is of Formula (I-b-4):

(IX-b-4)

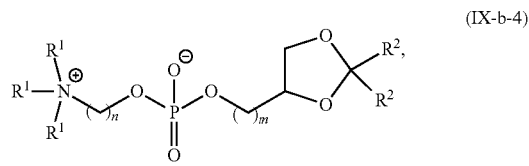

or a salt thereof.

In certain embodiments, the compound of Formula (IX-b) is one of the following:

more methylenes are replaced by cyclic or heteroatom groups, or any combination thereof. For example, in certain embodiments, the compound of (IX) is of Formula (IX-a), or a salt thereof, wherein at least one instance of $R^2$ is each instance of $R^2$ is optionally substituted $C_{1-30}$ alkyl, wherein one or more methylene units of $R^2$ are independently replaced with optionally substituted carbocyclylene, optionally substituted heterocyclylene, optionally substituted arylene, optionally substituted heteroarylene, —N($R^N$)—, —O—, —S—, —C(O)—, —C(O)N($R^N$)—, —$NR^N$C(O)—, —$NR^N$C(O)N($R^N$)—, —C(O)O—, —OC(O)—, —OC(O)O—, —OC(O)N($R^N$)—, —$NR^N$C(O)O—, —C(O)S—, —SC(O)—, —C(=$NR^N$)—, —C(=$NR^N$)N($R^N$)—, —$NR^N$C(=$NR^N$)—, —$NR^N$C(=$NR^N$)N($R^N$)—, —C(S)—, —C(S)N($R^N$)—, —$NR^N$C(S)—, —$NR^N$C(S)N($R^N$)—, —S(O)—, —OS(O)—, —S(O)O—, —OS(O)O—, —OS(O)$_2$—, —S(O)$_2$O—, —OS(O)$_2$O—, —N($R^N$)S(O)—, —S(O)N($R^N$)—, —N($R^N$)S(O)N($R^N$)—, —OS(O)N($R^N$)—, —N($R^N$)S(O)O—, —S(O)$_2$—, —N($R^N$)S(O)$_2$—, —S(O)$_2$N($R^N$)—, —N($R^N$)S(O)$_2$N($R^N$)—, —OS(O)$_2$N($R^N$)—, or —N($R^N$)S(O)$_2$O—.

In certain embodiments, the compound of Formula (IX) is of Formula (IX-c):

(IX-c)

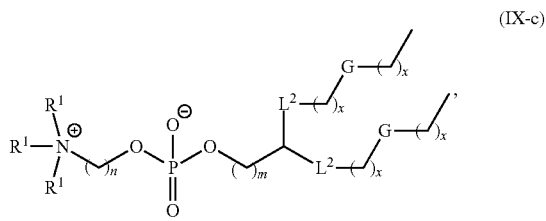

(Compound 454)

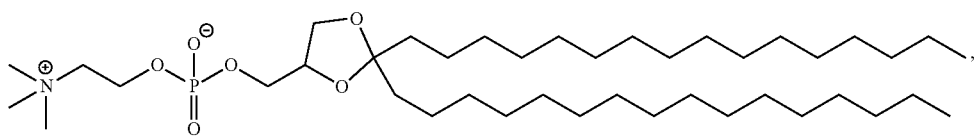

(Compound 455)

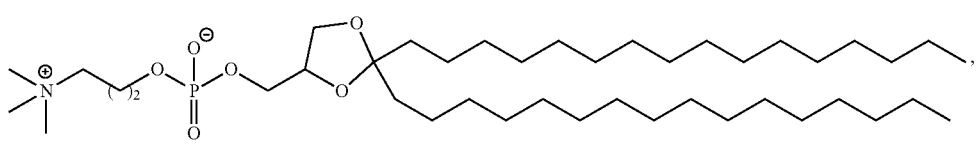

(Compound 456)

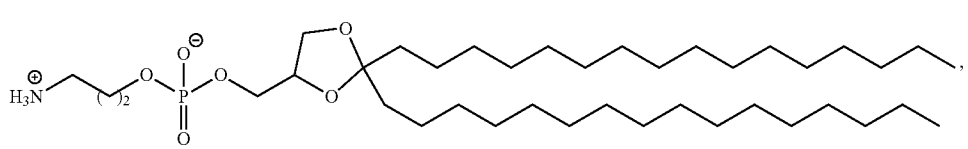

or salts thereof.

Phospholipid Tail Modifications

In certain embodiments, a phospholipid useful or potentially useful in the present invention comprises a modified tail. In certain embodiments, a phospholipid useful or potentially useful in the present invention is DSPC, or analog thereof, with a modified tail. As described herein, a "modified tail" may be a tail with shorter or longer aliphatic chains, aliphatic chains with branching introduced, aliphatic chains with substituents introduced, aliphatic chains wherein one or or a salt thereof, wherein:

each x is independently an integer between 0-30, inclusive; and each instance is G is independently selected from the group consisting of optionally substituted carbocyclylene, optionally substituted heterocyclylene, optionally substituted arylene, optionally substituted heteroarylene, —N($R^N$)—, —O—, —S—, —C(O)—, —C(O)N($R^N$)—, —$NR^N$C(O)—, —$NR^N$C(O)N($R^N$)—, —C(O)O—, —OC(O)—, —OC(O)O—, —OC(O)N(R$^N$)—, —NR$^N$C(O)O—, —C(O)S—, —SC(O)—, —C(=NR$^N$)—, —C(=NR$^N$)N(R$^N$)—, —NR$^N$C(=NR$^N$)—, —NR$^N$C(=NR$^N$)N(R$^N$)—, —C(S)—, —C(S)N(R$^N$)—, —NR$^N$C(S)—, —NR$^N$C(S)N(R$^N$)—, —S(O)—, —OS(O)—, —S(O)O—, —OS(O)O—, —OS(O)$_2$—, —S(O)$_2$O—, —OS(O)$_2$O—, —N(R$^N$)S(O)—, —S(O)N(R$^N$)—, —N(R$^N$)S(O)N(R$^N$)—, —OS(O)N(R$^N$)—, —N(R$^N$)S(O)O—, —S(O)$_2$—, —N(R$^N$)S(O)$_2$—, —S(O)$_2$N(R$^N$)—, —N(R$^N$)S(O)$_2$N(R$^N$)—, —OS(O)$_2$N(R$^N$)—, or —N(R$^N$)S(O)$_2$O—. Each possibility represents a separate embodiment of the present invention.

In certain embodiments, the compound of Formula (IX-c) is of Formula (IX-c-1):

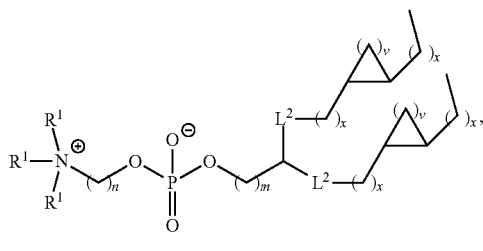

(IX-c-1)

or salt thereof, wherein:
each instance of v is independently 1, 2, or 3.

In certain embodiments, the compound of Formula (IX-c) is of Formula (IX-c-2):

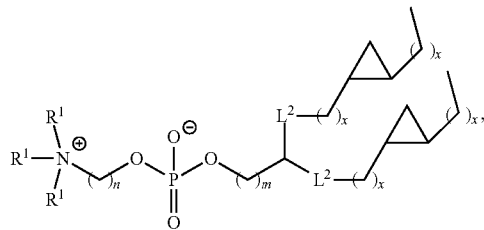

(IX-c-2)

or a salt thereof.

In certain embodiments, the compound of Formula (IX-c) is of the following formula:

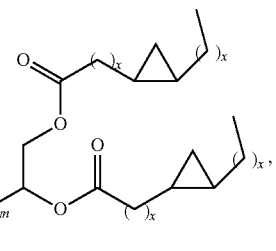

or a salt thereof.

In certain embodiments, the compound of Formula (IX-c) is the following:

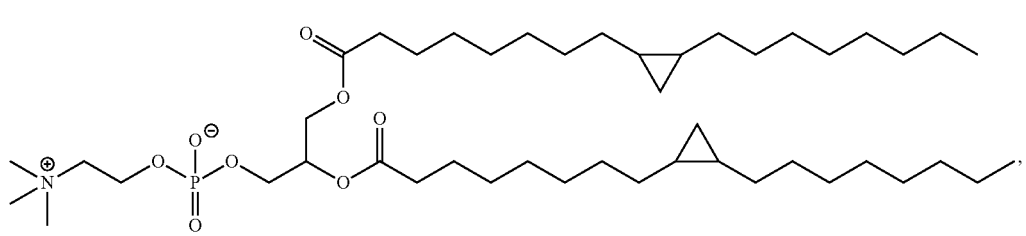

(Compound 457)

or a salt thereof.

In certain embodiments, the compound of Formula (IX-c) is of Formula (I-c-3):

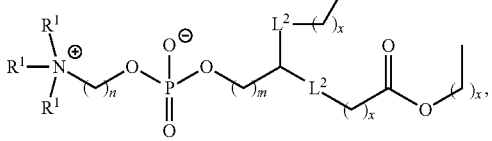

(IX-c-3)

or a salt thereof.

In certain embodiments, the compound of Formula (IX-c) is of the following formulae:

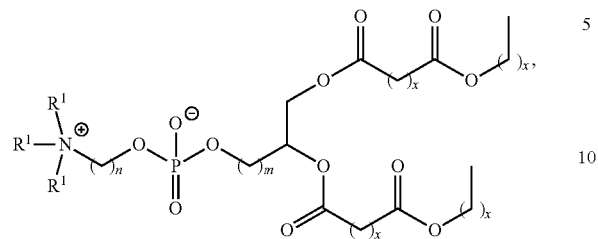

or a salt thereof.

In certain embodiments, the compound of Formula (IX-c) is the following:

(Compound 458)

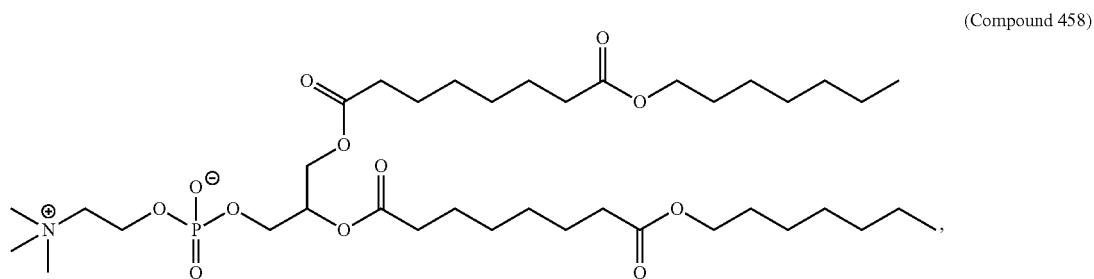 [SMILES: CCCCCCCOC(=O)CCCCCCC(=O)OCC(COP(=O)([O-])OCC[N+](C)(C)C)OC(=O)CCCCCCC(=O)OCCCCCCC]

or a salt thereof.

In certain embodiments, a phospholipid useful or potentially useful in the present invention comprises a modified phosphocholine moiety, wherein the alkyl chain linking the quaternary amine to the phosphoryl group is not ethylene (e.g., n is not 2). Therefore, in certain embodiments, a phospholipid useful or potentially useful in the present invention is a compound of Formula (IX), wherein n is 1, 3, 4, 5, 6, 7, 8, 9, or 10. For example, in certain embodiments, a compound of Formula (IX) is of one of the following formulae:

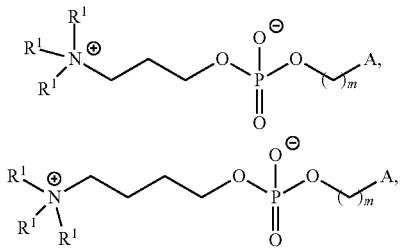

or a salt thereof.

In certain embodiments, a compound of Formula (IX) is one of the following:

(Compound 459)

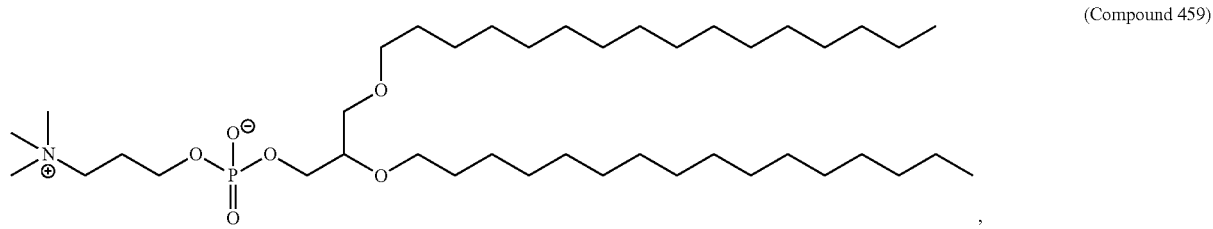

(Compound 460)

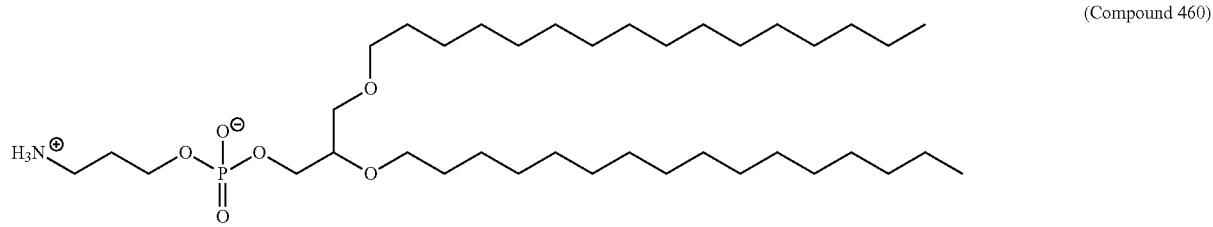

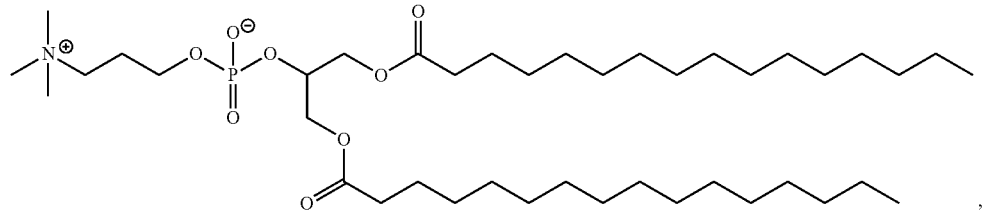
(Compound 461)
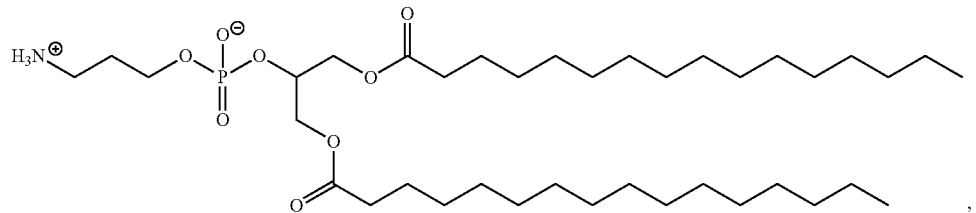
(Compound 462)
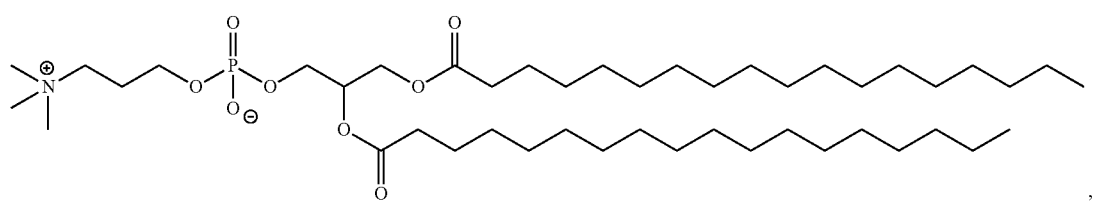
(Compound 463)
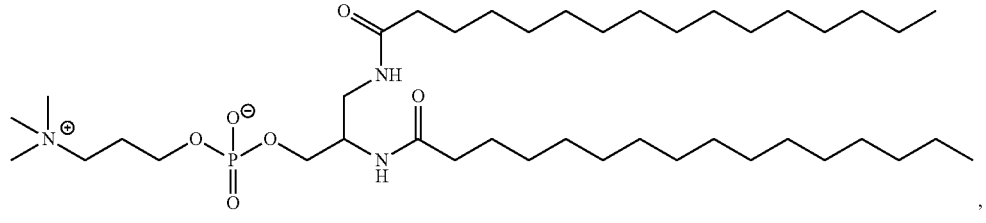
(Compound 464)
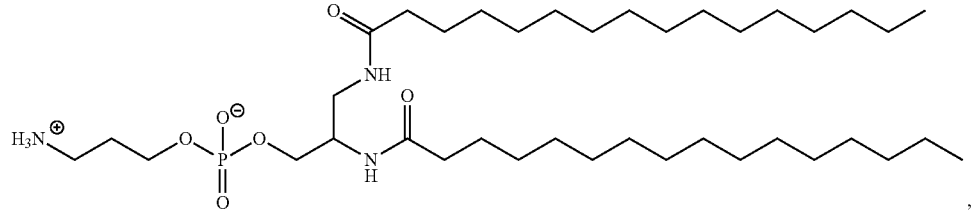
(Compound 463)
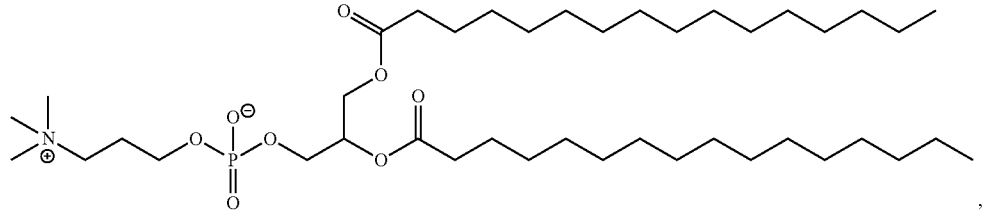
(Compound 412)
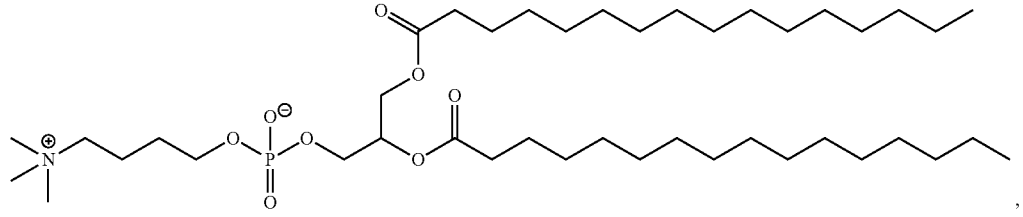
(Compound 413)

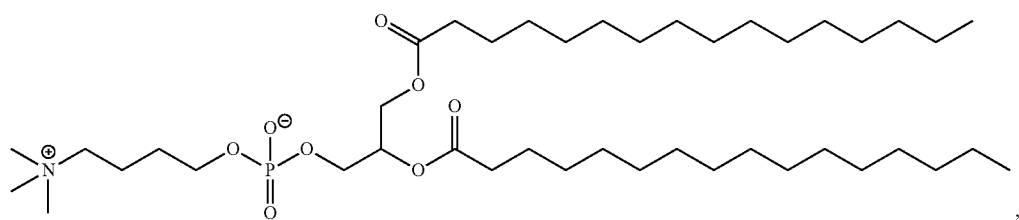
(Compound 414)
or salts thereof.
Alternative Lipids
In certain embodiments, an alternative lipid is used in place of a phospholipid of the invention. Non-limiting examples of such alternative lipids include the following:
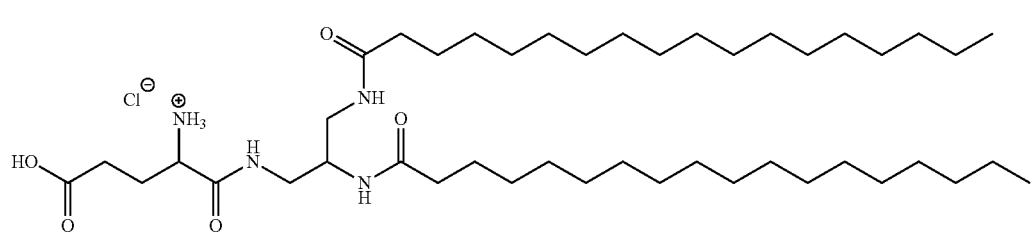
Compound 457
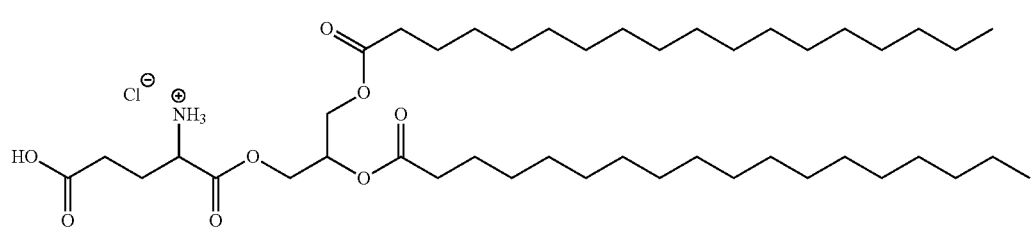
Compound 458
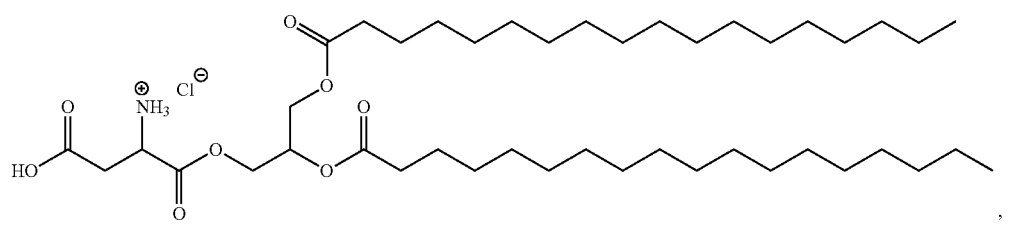
Compound 459
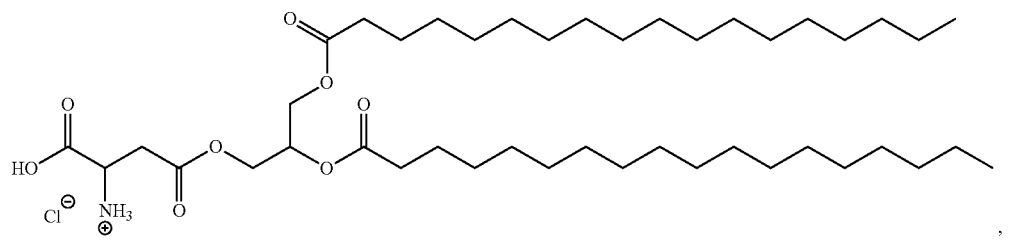
Compound 460
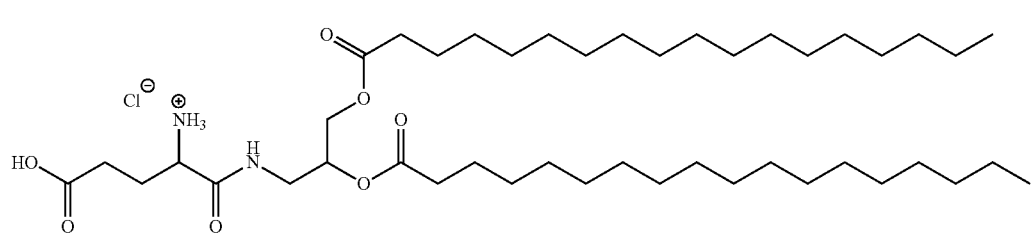
Compound 461

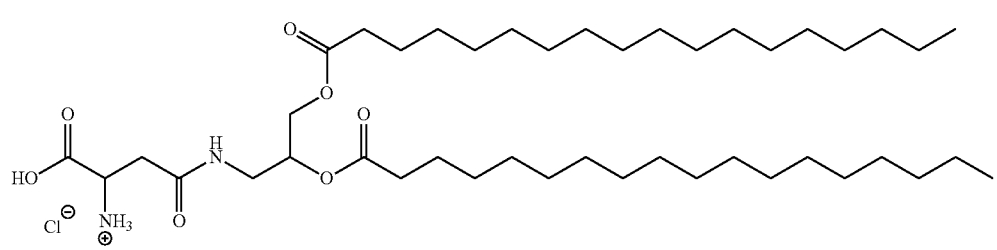

Compound 461

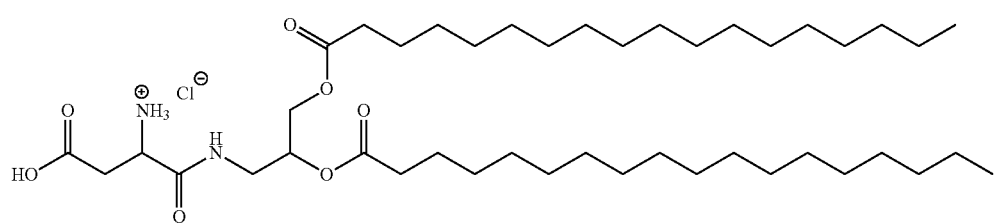

, and

Compound 463

The lipid component of a lipid nanoparticle composition may include one or more structural lipids. Incorporation of structural lipids in the lipid nanoparticle may help mitigate aggregation of other lipids in the particle. Structural lipids can be selected from the group including but not limited to, cholesterol, fecosterol, sitosterol, ergosterol, campesterol, stigmasterol, brassicasterol, tomatidine, tomatine, ursolic acid, alpha-tocopherol, hopanoids, phytosterols, steroids, and mixtures thereof. In some embodiments, the structural lipid is a sterol. As defined herein, "sterols" are a subgroup of steroids consisting of steroid alcohols. In certain embodiments, the structural lipid is a steroid. In certain embodiments, the structural lipid is cholesterol. In certain embodiments, the structural lipid is an analog of cholesterol. In certain embodiments, the structural lipid is alpha-tocopherol. Examples of structural lipids include, but are not limited to, the following:

(Compound 464)

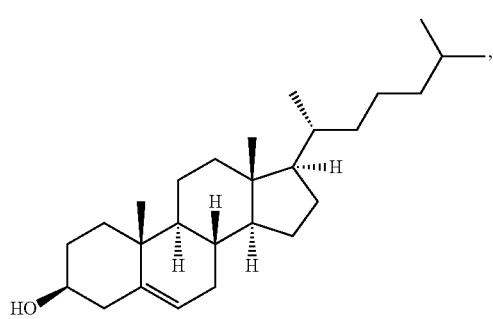

(Compound 465)

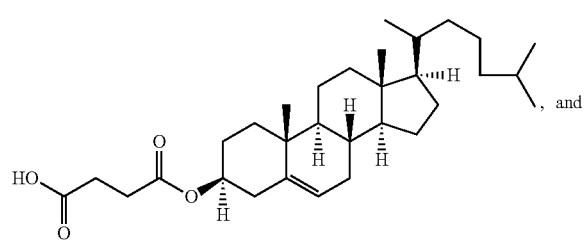

, and (Compound 466)

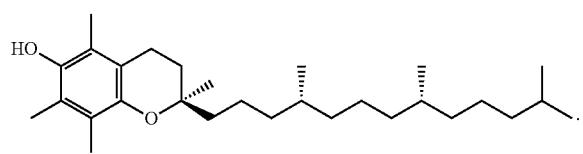

Lipid nanoparticles typically comprise one or more of the following components: lipids (which may include ionizable amino lipids, phospholipids, helper lipids which may be neutral lipids, zwitterionic lipid, anionic lipids, and the like), structural lipids such as cholesterol or cholesterol analogs, fatty acids, polymers, stabilizers, salts, buffers, solvent, and the like.

Certain of the LNPs provided herein comprise an ionizable lipid, such as an ionizable lipid, e.g., an ionizable amino lipid, a phospholipid, a structural lipid, and optionally a stabilizer (e.g., a molecule comprising polyethylene glycol) which may or may not be provided conjugated to another lipid.

The ionizable lipid may be but is not limited to DLin-DMA, DLin-D-DMA, DLin-MC3-DMA, DLin-KC2-DMA and DODMA. The ionizable lipid may be an ionizable amino lipid as described in more detail below. In some embodiments, the ionizable lipid is not DLin-MC3-DMA.

The structural lipid may be but is not limited to a sterol such as for example cholesterol.

The helper lipid is a non-cationic lipid. The helper lipid may comprise at least one fatty acid chain of at least 8C and at least one polar headgroup moiety.

When a molecule comprising polyethylene glycol (i.e. PEG) is used, it may be used as a stabilizer In some embodiments, the molecule comprising polyethylene glycol may be polyethylene glycol conjugated to a lipid and thus may be provided as PEG-c-DOMG or PEG-DMG, for example. Certain of the LNPs provided herein comprise no or low levels of PEGylated lipids, including no or low levels of alkyl-PEGylated lipids, and may be referred to herein as being free of PEG or PEGylated lipid. Thus, some LNPs comprise less than 0.5 mol % PEGylated lipid. In some instances, PEG may be an alkyl-PEG such as methoxy-PEG.

Still other LNPs comprise non-alkyl-PEG such as hydroxy-PEG, and/or non-alkyl-PEGylated lipids such as hydroxy-PEGylated lipids.

In some embodiments, a nanoparticle composition can have the formulation of Compound 18:Phospholipid:Chol:Compound 781 with a mole ratio of 50:10:38.5:1.5. In some embodiments, a nanoparticle composition can have the formulation of Compound 18:DSPC:Chol:Compound 428 with a mole ratio of 50:10:38.5:1.5.

Compound 428

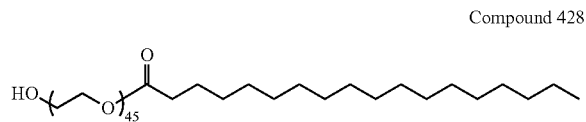

In some embodiments the LNP comprises a miR binding site. In other embodiments the miR binding site is selected from miR 126, miR 155, and miR 142 3p. The miR binding site is incorporated into a mRNA in some embodiments. In other embodiments the miR binding site is separate from the mRNA.

In various embodiments, the mRNA comprises 1-4, one, two, three or four miR binding sites, wherein at least one of the miR binding sites is a miR-126 binding site. In one embodiment, the mRNA, comprises at least two microRNA binding sites, wherein at least one of the microRNA binding sites is a miR-126 binding site. In one embodiment, the mRNA, e.g., mmRNA, comprises a miR-126 binding site and a second microRNA binding site for a miR selected from the group consisting of miR-142-3p, miR-142-5p, miR-146-3p, miR-146-5p, miR-155, miR-16, miR-21, miR-223, miR-24 and miR-27. In another embodiment, the mRNA, comprises a miR-126 (e.g., miR-126-3p) binding site and a miR-142 (e.g., miR-142-3p) binding site. It has now been discovered that incorporation of at least one microRNA binding site for a microRNA expressed in immune cells (e.g., miR-126, miR-142, miR-155 and combinations thereof) into an mRNA construct can reduce or inhibit ABC when the lipid-comprising compound or composition comprising the mRNA is administered to a subject. In one embodiment, the mechanism of action of the miRNA binding site(s) is a microRNA "sponge", wherein the miRNA binding site(s) in the construct or LNP "soaks up" microRNAs that bind to the binding site(s).

It has been discovered according to the invention that delivery of a miR binding site will inhibit an immune response, avoiding the production of ADA and can be used to provide repeated dosing of a subject with an LNP without susceptibility to accelerated blood clearance (ABC). The miR binding site may be incorporated into a therapeutic nucleic acid that is being delivered in the LNP. Alternatively the miR binding site may separately be incorporated into the same LNP that incorporates the therapeutic nucleic acid or into a different LNP. The miR binding site may be administered to the subject in a separate vehicle at the same or different time as the LNP and may or may not be incorporated into an LNP. In some embodiments the miR binding site may be a miR sponge.

Although Applicant is not bound by mechanism, it is believed that the miR binding site act to soak up endogenous, targeted miRNA of interest, preventing that miRNA from functioning in the cell. It is possible to target miRNA that play a positive role in regulation of immune cell function. By inhibiting the function of endogenous miRNA the miR binding site acts as an inhibitor to block the miRNA function and other downstream effects resulting from this targeting inhibition. The miRNA binding agent may also or alternatively be functioning by preventing protein translation in specific tissues or cells, such as the spleen or immune cells. By preventing translation of, for instance, an mRNA therapeutic encapsulated in the LNP, in specific tissues that are high in immune cells, the immune response in those tissues will be decreased, while not having an impact on mRNA expression in other tissues.

It has been demonstrated that introduction of miR binding sites such as miR 126 (highly abundant in pDC) results in a reduction in B cell activation, a reduction in pDC activation, a reduction in cytokine expression, such as IL6 and IFN-gamma, and a reduction in IgM relative to the response delivered by a corresponding LNP without the miR binding site.

In some embodiments the miR binding site is a miR 126, miR 155, and/or miR 142.3p binding site. In some embodiments, the mRNA can comprise at least one miR binding site to thereby reduce or inhibit an immune response. The miR binding site may be found in, for instance, the 3' UTR of the mRNA.

It has been demonstrated that introduction of miR binding sites such as miR 126 (highly abundant in pDC) results in a reduction in B cell activation, a reduction in pDC activation, a reduction in cytokine expression, such as IL6 and IFN-gamma, and a reduction in IgM relative to the response delivered by a corresponding LNP without the miR binding site.

Nanoparticle compositions of the present disclosure comprise at least one compound according to Formula (I). For example, the nanoparticle composition can include one or more of Compounds 1-147. Nanoparticle compositions can also include a variety of other components. For example, the nanoparticle composition can include one or more other lipids in addition to a lipid according to Formula (I) or (II), for example (i) at least one phospholipid, (ii) at least one structural lipid, (iii) at least one PEG-lipid, or (iv) any combination thereof.

In some embodiments, the nanoparticle composition comprises a compound of Formula (I), (e.g., Compounds 18, 25, 26 or 48). In some embodiments, the nanoparticle composition comprises a compound of Formula (I) (e.g., Compounds 18, 25, 26 or 48) and a phospholipid (e.g., DSPC, DOP, or MSPC).

m. Cells or Minicells

In some embodiments, the compositions or formulations of the present disclosure comprise the polynucleotides described herein (e.g., a polynucleotide comprising a nucleotide sequence encoding a CFTR polypeptide) that is transfected ex vivo into cells, which are subsequently transplanted into a subject. Cell-based formulations of the polynucleotide disclosed herein can be used to ensure cell transfection (e.g., in the cellular carrier), alter the biodistribution of the polynucleotide (e.g., by targeting the cell carrier to specific tissues or cell types), and/or increase the translation of encoded protein.

Exemplary cells include, but are not limited to, red blood cells, virosomes, and electroporated cells (see e.g., Godfrin et al., Expert Opin Biol Ther. 2012 12:127-133; Fang et al., Expert Opin Biol Ther. 2012 12:385-389; Hu et al., Proc Natl Acad Sci USA. 2011 108:10980-10985; Lund et al., Pharm Res. 2010 27:400-420; Huckriede et al., J Liposome Res. 2007; 17:39-47; Cusi, Hum Vaccin. 2006 2:1-7; de Jonge et al., Gene Ther. 2006 13:400-411; all of which are herein incorporated by reference in its entirety).

A variety of methods are known in the art and are suitable for introduction of nucleic acid into a cell, including viral and non-viral mediated techniques. Examples of typical non-viral mediated techniques include, but are not limited to, electroporation, calcium phosphate mediated transfer, nucleofection, sonoporation, heat shock, magnetofection, liposome mediated transfer, microinjection, microprojectile mediated transfer (nanoparticles), cationic polymer mediated transfer (DEAE-dextran, polyethylenimine, polyethylene glycol (PEG) and the like) or cell fusion.

In some embodiments, the polynucleotides described herein can be delivered in synthetic virus-like particles (VLPs) synthesized by the methods as described in Intl. Pub Nos. WO2011085231 and WO2013116656; and U.S. Pub. No. 20110171248, each of which is herein incorporated by reference in its entirety.

The technique of sonoporation, or cellular sonication, is the use of sound (e.g., ultrasonic frequencies) for modifying the permeability of the cell plasma membrane. Sonoporation methods are known to deliver nucleic acids in vivo (Yoon and Park, Expert Opin Drug Deliv. 2010 7:321-330; Postema and Gilja, Curr Pharm Biotechnol. 2007 8:355-361; Newman and Bettinger, Gene Ther. 2007 14:465-475; U.S. Pub. Nos. US20100196983 and US20100009424; all herein incorporated by reference in their entirety).

In some embodiments, the polynucleotides described herein can be delivered by electroporation. Electroporation techniques are known to deliver nucleic acids in vivo and clinically (Andre et al., Curr Gene Ther. 2010 10:267-280; Chiarella et al., Curr Gene Ther. 2010 10:281-286; Hojman, Curr Gene Ther. 2010 10:128-138; all herein incorporated by reference in their entirety). Electroporation devices are sold by many companies worldwide including, but not limited to BTX® Instruments (Holliston, MA) (e.g., the AgilePulse In Vivo System) and Inovio (Blue Bell, PA) (e.g., Inovio SP-5P intramuscular delivery device or the CELLECTRA® 3000 intradermal delivery device).

In some embodiments, the cells are selected from the group consisting of mammalian cells, bacterial cells, plant, microbial, algal and fungal cells. In some embodiments, the cells are mammalian cells, such as, but not limited to, human, mouse, rat, goat, horse, rabbit, hamster or cow cells. In a further embodiment, the cells can be from an established cell line, including, but not limited to, HeLa, NSO, SP2/0, KEK 293T, Vero, Caco, Caco-2, MDCK, COS-1, COS-7, K562, Jurkat, CHO-K1, DG44, CHOK1SV, CHO—S, Huvec, CV-1, Huh-7, NIH₃T3, HEK293, 293, A549, HepG2, IMR-90, MCF-7, U-20S, Per.C6, SF9, SF21 or Chinese Hamster Ovary (CHO) cells.

In certain embodiments, the cells are fungal cells, such as, but not limited to, Chrysosporium cells, Aspergillus cells, Trichoderma cells, Dictyostelium cells, Candida cells, Saccharomyces cells, Schizosaccharomyces cells, and Penicillium cells.

In certain embodiments, the cells are bacterial cells such as, but not limited to, *E. coli, B. subtilis*, or BL21 cells. Primary and secondary cells to be transfected by the methods of the present disclosure can be obtained from a variety of tissues and include, but are not limited to, all cell types that can be maintained in culture. The primary and secondary cells include, but are not limited to, fibroblasts, keratinocytes, epithelial cells (e.g., mammary epithelial cells, intestinal epithelial cells), endothelial cells, glial cells, neural cells, formed elements of the blood (e.g., lymphocytes, bone marrow cells), muscle cells and precursors of these somatic cell types. Primary cells can also be obtained from a donor of the same species or from another species (e.g., mouse, rat, rabbit, cat, dog, pig, cow, bird, sheep, goat, horse).

In some embodiments, the compositions or formulations of the present disclosure comprise the polynucleotides described herein in bacterial minicells. As a non-limiting example, bacterial minicells can be those described in Intl. Pub. No. WO2013088250 or U.S. Pub. No. US20130177499, each of which is herein incorporated by reference in its entirety.

n. Semi-Solid Compositions

In some embodiments, the compositions or formulations of the present disclosure comprise the polynucleotides described herein (e.g., a polynucleotide comprising a nucleotide sequence encoding a CFTR polypeptide) in a hydrophobic matrix to form a semi-solid or paste-like composition. As a non-limiting example, the semi-solid or paste-like composition can be made by the methods described in Intl. Pub. No. WO201307604, herein incorporated by reference in its entirety.

o. Exosomes

In some embodiments, the compositions or formulations of the present disclosure comprise the polynucleotides described herein (e.g., a polynucleotide comprising a nucleotide sequence encoding a CFTR polypeptide) in exosomes, which can be loaded with at least one polynucleotide and delivered to cells, tissues and/or organisms. As a non-limiting example, the polynucleotides can be loaded in the exosomes as described in Intl. Pub. No. WO2013084000, herein incorporated by reference in its entirety.

r. Microvesicles

In some embodiments, the compositions or formulations of the present disclosure comprise the polynucleotides described herein (e.g., a polynucleotide comprising a nucleotide sequence encoding a CFTR polypeptide) in a microvesicle formulation. Exemplary microvesicles include those described in U.S. Pub. No. US20130209544 (herein incorporated by reference in its entirety). In some embodiments, the microvesicle is an ARRDC1-mediated microvesicles (ARMMs) as described in Intl. Pub. No. WO2013119602 (herein incorporated by reference in its entirety).

s. Interpolyelectrolyte Complexes

In some embodiments, the compositions or formulations of the present disclosure comprise the polynucleotides described herein (e.g., a polynucleotide comprising a nucleotide sequence encoding a CFTR polypeptide) in an interpolyelectrolyte complex. Interpolyelectrolyte complexes are formed when charge-dynamic polymers are complexed with one or more anionic molecules. Non-limiting examples of charge-dynamic polymers and interpolyelectrolyte complexes and methods of making interpolyelectrolyte complexes are described in U.S. Pat. No. 8,524,368, herein incorporated by reference in its entirety.

t. Crystalline Polymeric Systems

In some embodiments, the compositions or formulations of the present disclosure comprise the polynucleotides described herein (e.g., a polynucleotide comprising a nucleotide sequence encoding a CFTR polypeptide) in crystalline polymeric systems. Crystalline polymeric systems are polymers with crystalline moieties and/or terminal units comprising crystalline moieties. Exemplary polymers are described in U.S. Pat. No. 8,524,259 (herein incorporated by reference in its entirety).

u. Polymers, Biodegradable Nanoparticles, and Core-Shell Nanoparticles

In some embodiments, the compositions or formulations of the present disclosure comprise the polynucleotides described herein (e.g., a polynucleotide comprising a nucleotide sequence encoding a CFTR polypeptide) and a natural and/or synthetic polymer. The polymers include, but not limited to, polyethenes, polyethylene glycol (PEG), poly(l-lysine)(PLL), PEG grafted to PLL, cationic lipopolymer, biodegradable cationic lipopolymer, polyethyleneimine (PEI), cross-linked branched poly(alkylene imines), a polyamine derivative, a modified poloxamer, elastic biodegradable polymer, biodegradable copolymer, biodegradable polyester copolymer, biodegradable polyester copolymer, multiblock copolymers, poly [α-(4-aminobutyl)-L-glycolic acid) (PAGA), biodegradable cross-linked cationic multi-block copolymers, polycarbonates, polyanhydrides, polyhydroxyacids, polypropylfumerates, polycaprolactones, polyamides, polyacetals, polyethers, polyesters, poly (orthoesters), polycyanoacrylates, polyvinyl alcohols, polyurethanes, polyphosphazenes, polyureas, polystyrenes, polyamines, polylysine, poly(ethylene imine), poly(serine ester), poly(L-lactide-co-L-lysine), poly(4-hydroxy-L-proline ester), amine-containing polymers, dextran polymers, dextran polymer derivatives or combinations thereof.

Exemplary polymers include, DYNAMIC POLYCONJUGATE® (Arrowhead Research Corp., Pasadena, CA) formulations from MIRUS® Bio (Madison, WI) and Roche Madison (Madison, WI), PHASERX™ polymer formulations such as, without limitation, SMARTT POLYMER TECHNOLOGY™ (PHASERX®, Seattle, WA), DMRI/DOPE, poloxamer, VAXFECTIN® adjuvant from Vical (San Diego, CA), chitosan, cyclodextrin from Calando Pharmaceuticals (Pasadena, CA), dendrimers and poly(lactic-co-glycolic acid) (PLGA) polymers. RONDEL™ (RNAi/Oligonucleotide Nanoparticle Delivery) polymers (Arrowhead Research Corporation, Pasadena, CA) and pH responsive co-block polymers such as PHASERX® (Seattle, WA).

The polymer formulations allow a sustained or delayed release of the polynucleotide (e.g., following intramuscular or subcutaneous injection). The altered release profile for the polynucleotide can result in, for example, translation of an encoded protein over an extended period of time. The polymer formulation can also be used to increase the stability of the polynucleotide. Sustained release formulations can include, but are not limited to, PLGA microspheres, ethylene vinyl acetate (EVAc), poloxamer, GELSITE® (Nanotherapeutics, Inc. Alachua, FL), HYLENEX® (Halozyme Therapeutics, San Diego CA), surgical sealants such as fibrinogen polymers (Ethicon Inc. Cornelia, GA), TISSELL® (Baxter International, Inc. Deerfield, IL), PEG-based sealants, and COSEAL® (Baxter International, Inc. Deerfield, IL).

As a non-limiting example modified mRNA can be formulated in PLGA microspheres by preparing the PLGA microspheres with tunable release rates (e.g., days and weeks) and encapsulating the modified mRNA in the PLGA microspheres while maintaining the integrity of the modified mRNA during the encapsulation process. EVAc are non-biodegradable, biocompatible polymers that are used extensively in pre-clinical sustained release implant applications (e.g., extended release products Ocusert a pilocarpine ophthalmic insert for glaucoma or progestasert a sustained release progesterone intrauterine device; transdermal delivery systems Testoderm, Duragesic and Selegiline; catheters). Poloxamer F-407 NF is a hydrophilic, non-ionic surfactant triblock copolymer of polyoxyethylene-polyoxypropylene-polyoxyethylene having a low viscosity at temperatures less than 5° C. and forms a solid gel at temperatures greater than 15° C.

As a non-limiting example, the polynucleotides described herein can be formulated with the polymeric compound of PEG grafted with PLL as described in U.S. Pat. No. 6,177,274. As another non-limiting example, the polynucleotides described herein can be formulated with a block copolymer such as a PLGA-PEG block copolymer (see e.g., U.S. Pub. No. US20120004293 and U.S. Pat. Nos. 8,236,330 and 8,246,968), or a PLGA-PEG-PLGA block copolymer (see e.g., U.S. Pat. No. 6,004,573). Each of the references is herein incorporated by reference in its entirety.

In some embodiments, the polynucleotides described herein can be formulated with at least one amine-containing polymer such as, but not limited to polylysine, polyethylene imine, poly(amidoamine) dendrimers, poly(amine-co-esters) or combinations thereof. Exemplary polyamine polymers and their use as delivery agents are described in, e.g., U.S. Pat. Nos. 8,460,696, 8,236,280, each of which is herein incorporated by reference in its entirety.

In some embodiments, the polynucleotides described herein can be formulated in a biodegradable cationic lipopolymer, a biodegradable polymer, or a biodegradable copolymer, a biodegradable polyester copolymer, a biodegradable polyester polymer, a linear biodegradable copolymer, PAGA, a biodegradable cross-linked cationic multi-block copolymer or combinations thereof as described in, e.g., U.S. Pat. Nos. 6,696,038, 6,517,869, 6,267,987, 6,217,912, 6,652,886, 8,057,821, and 8,444,992; U.S. Pub. Nos. US20030073619, US20040142474, US20100004315, US2012009145 and US20130195920; and Intl Pub. Nos. WO2006063249 and WO2013086322, each of which is herein incorporated by reference in its entirety.

In some embodiments, the polynucleotides described herein can be formulated in or with at least one cyclodextrin polymer as described in U.S. Pub. No. US20130184453. In some embodiments, the polynucleotides described herein can be formulated in or with at least one crosslinked cation-binding polymers as described in Intl. Pub. Nos. WO2013106072, WO2013106073 and WO2013106086. In some embodiments, the polynucleotides described herein can be formulated in or with at least PEGylated albumin polymer as described in U.S. Pub. No. US20130231287. Each of the references is herein incorporated by reference in its entirety.

In some embodiments, the polynucleotides disclosed herein can be formulated as a nanoparticle using a combination of polymers, lipids, and/or other biodegradable agents, such as, but not limited to, calcium phosphate. Components can be combined in a core-shell, hybrid, and/or layer-by-layer architecture, to allow for fine-tuning of the nanoparticle for delivery (Wang et al., Nat Mater. 2006 5:791-796; Fuller et al., Biomaterials. 2008 29:1526-1532; DeKoker et al., Adv Drug Deliv Rev. 2011 63:748-761; Endres et al., Biomaterials. 2011 32:7721-7731; Su et al., Mol Pharm. 2011 Jun 6; 8(3):774-87; herein incorporated by reference in their entireties). As a non-limiting example, the nanoparticle can comprise a plurality of polymers such as, but not limited to hydrophilic-hydrophobic polymers (e.g., PEG-PLGA), hydrophobic polymers (e.g., PEG) and/or hydrophilic polymers (Intl. Pub. No. WO20120225129, herein incorporated by reference in its entirety).

The use of core-shell nanoparticles has additionally focused on a high-throughput approach to synthesize cationic cross-linked nanogel cores and various shells (Siegwart et al., Proc Natl Acad Sci USA. 2011 108:12996-

13001; herein incorporated by reference in its entirety). The complexation, delivery, and internalization of the polymeric nanoparticles can be precisely controlled by altering the chemical composition in both the core and shell components of the nanoparticle. For example, the core-shell nanoparticles can efficiently deliver siRNA to mouse hepatocytes after they covalently attach cholesterol to the nanoparticle.

In some embodiments, a hollow lipid core comprising a middle PLGA layer and an outer neutral lipid layer containing PEG can be used to delivery of the polynucleotides as described herein. In some embodiments, the lipid nanoparticles can comprise a core of the polynucleotides disclosed herein and a polymer shell, which is used to protect the polynucleotides in the core. The polymer shell can be any of the polymers described herein and are known in the art., the polymer shell can be used to protect the polynucleotides in the core.

Core-shell nanoparticles for use with the polynucleotides described herein are described in U.S. Pat. No. 8,313,777 or Intl. Pub. No. WO2013124867, each of which is herein incorporated by reference in their entirety.

v. Peptides and Proteins

In some embodiments, the compositions or formulations of the present disclosure comprise the polynucleotides described herein (e.g., a polynucleotide comprising a nucleotide sequence encoding a CFTR polypeptide) that is formulated with peptides and/or proteins to increase transfection of cells by the polynucleotide, and/or to alter the biodistribution of the polynucleotide (e.g., by targeting specific tissues or cell types), and/or increase the translation of encoded protein (e.g., Intl. Pub. Nos. WO2012110636 and WO2013123298. In some embodiments, the peptides can be those described in U.S. Pub. Nos. US20130129726, US20130137644 and US20130164219. Each of the references is herein incorporated by reference in its entirety.

w. Conjugates

In some embodiments, the compositions or formulations of the present disclosure comprise the polynucleotides described herein (e.g., a polynucleotide comprising a nucleotide sequence encoding a CFTR polypeptide) that is covalently linked to a carrier or targeting group, or including two encoding regions that together produce a fusion protein (e.g., bearing a targeting group and therapeutic protein or peptide) as a conjugate. The conjugate can be a peptide that selectively directs the nanoparticle to neurons in a tissue or organism, or assists in crossing the blood-brain barrier.

The conjugates include a naturally occurring substance, such as a protein (e.g., human serum albumin (HSA), low-density lipoprotein (LDL), high-density lipoprotein (HDL), or globulin); an carbohydrate (e.g., a dextran, pullulan, chitin, chitosan, inulin, cyclodextrin or hyaluronic acid); or a lipid. The ligand can also be a recombinant or synthetic molecule, such as a synthetic polymer, e.g., a synthetic polyamino acid, an oligonucleotide (e.g., an aptamer). Examples of polyamino acids include polyamino acid is a polylysine (PLL), poly L-aspartic acid, poly L-glutamic acid, styrene-maleic acid anhydride copolymer, poly (L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamides polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

In some embodiments, the conjugate can function as a carrier for the polynucleotide disclosed herein. The conjugate can comprise a cationic polymer such as, but not limited to, polyamine, polylysine, polyalkylenimine, and polyethylenimine that can be grafted to with poly(ethylene glycol). Exemplary conjugates and their preparations are described in U.S. Pat. No. 6,586,524 and U.S. Pub. No. US20130211249, each of which herein is incorporated by reference in its entirety.

The conjugates can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, an RGD peptide, an RGD peptide mimetic or an aptamer.

Targeting groups can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Targeting groups can also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, multivalent frucose, or aptamers. The ligand can be, for example, a lipopolysaccharide, or an activator of p38 MAP kinase.

The targeting group can be any ligand that is capable of targeting a specific receptor. Examples include, without limitation, folate, GalNAc, galactose, mannose, mannose-6P, apatamers, integrin receptor ligands, chemokine receptor ligands, transferrin, biotin, serotonin receptor ligands, PSMA, endothelin, GCPII, somatostatin, LDL, and HDL ligands. In particular embodiments, the targeting group is an aptamer. The aptamer can be unmodified or have any combination of modifications disclosed herein. As a non-limiting example, the targeting group can be a glutathione receptor (GR)-binding conjugate for targeted delivery across the blood-central nervous system barrier as described in, e.g., U.S. Pub. No. US2013021661012 (herein incorporated by reference in its entirety).

In some embodiments, the conjugate can be a synergistic biomolecule-polymer conjugate, which comprises a long-acting continuous-release system to provide a greater therapeutic efficacy. The synergistic biomolecule-polymer conjugate can be those described in U.S. Pub. No. US20130195799. In some embodiments, the conjugate can be an aptamer conjugate as described in Intl. Pat. Pub. No. WO2012040524. In some embodiments, the conjugate can be an amine containing polymer conjugate as described in U.S. Pat. No. 8,507,653. Each of the references is herein incorporated by reference in its entirety. In some embodiments, the polynucleotides can be conjugated to SMARTT POLYMER TECHNOLOGY® (PHASERX®, Inc. Seattle, WA).

In some embodiments, the polynucleotides described herein are covalently conjugated to a cell penetrating polypeptide, which can also include a signal sequence or a targeting sequence. The conjugates can be designed to have increased stability, and/or increased cell transfection; and/or altered the biodistribution (e.g., targeted to specific tissues or cell types).

In some embodiments, the polynucleotides described herein can be conjugated to an agent to enhance delivery. In some embodiments, the agent can be a monomer or polymer such as a targeting monomer or a polymer having targeting blocks as described in Intl. Pub. No. WO2011062965. In some embodiments, the agent can be a transport agent covalently coupled to a polynucleotide as described in, e.g., U.S. Pat. Nos. 6,835.393 and 7,374,778. In some embodiments, the agent can be a membrane barrier transport enhancing agent such as those described in U.S. Pat. Nos. 7,737,108 and 8,003,129. Each of the references is herein incorporated by reference in its entirety.

x. Micro-Organs

In some embodiments, the compositions or formulations of the present disclosure comprise the polynucleotides described herein (e.g., a polynucleotide comprising a nucleotide sequence encoding a CFTR polypeptide) in a micro-organ that can then express an encoded polypeptide of interest in a long-lasting therapeutic formulation. Exemplary micro-organs and formulations are described in Intl. Pub. No. WO2014152211 (herein incorporated by reference in its entirety).

y. Pseudovirions

In some embodiments, the compositions or formulations of the present disclosure comprise the polynucleotides described herein (e.g., a polynucleotide comprising a nucleotide sequence encoding a CFTR polypeptide) in pseudovirions (e.g., pseudovirions developed by Aura Biosciences, Cambridge, MA).

In some embodiments, the pseudovirion used for delivering the polynucleotides can be derived from viruses such as, but not limited to, herpes and papillomaviruses as described in, e.g., U.S. Pub. Nos. US20130012450, US20130012566, US21030012426 and US20120207840; and Intl. Pub. No. WO2013009717, each of which is herein incorporated by reference in its entirety.

The pseudovirion can be a virus-like particle (VLP) prepared by the methods described in U.S. Pub. Nos. US20120015899 and US20130177587, and Intl. Pub. Nos. WO2010047839, WO2013116656, WO2013106525 and WO2013122262. In one aspect, the VLP can be bacteriophages MS, Q13, $R_{17}$, fr, GA, Sp, MI, I, MXI, NL95, AP205, f2, PP7, and the plant viruses Turnip crinkle virus (TCV), Tomato bushy stunt virus (TBSV), Southern bean mosaic virus (SBMV) and members of the genus Bromovirus including Broad bean mottle virus, Brome mosaic virus, Cassia yellow blotch virus, Cowpea chlorotic mottle virus (CCMV), Melandrium yellow fleck virus, and Spring beauty latent virus. In another aspect, the VLP can be derived from the influenza virus as described in U.S. Pub. No. US20130177587 and U.S. Pat. No. 8,506,967. In one aspect, the VLP can comprise a B7-1 and/or B7-2 molecule anchored to a lipid membrane or the exterior of the particle such as described in Intl. Pub. No. WO2013116656. In one aspect, the VLP can be derived from norovirus, rotavirus recombinant VP6 protein or double layered VP2/VP6 such as the VLP as described in Intl. Pub. No. WO2012049366. Each of the references is herein incorporated by reference in its entirety.

In some embodiments, the pseudovirion can be a human papilloma virus-like particle as described in Intl. Pub. No. WO2010120266 and U.S. Pub. No. US20120171290. In some embodiments, the virus-like particle (VLP) can be a self-assembled particle. In one aspect, the pseudovirions can be virion derived nanoparticles as described in U.S. Pub. Nos. US20130116408 and US20130115247; and Intl. Pub. No. WO2013119877. Each of the references is herein incorporated by reference in their entirety.

Non-limiting examples of formulations and methods for formulating the polynucleotides described herein are also provided in Intl. Pub. No WO2013090648 (incorporated herein by reference in their entirety).

23. Methods of Use

The polynucleotides, pharmaceutical compositions and formulations described above are used in the preparation, manufacture and therapeutic use of to treat and/or prevent CFTR-related diseases, disorders or conditions. In some embodiments, the polynucleotides, compositions and formulations of the present disclosure are used to treat and/or prevent CF.

In some embodiments, the polynucleotides, pharmaceutical compositions and formulations of the present disclosure are used in methods for reducing cellular sodium levels in a subject in need thereof. For instance, one aspect of the present disclosure provides a method of alleviating the signs and symptoms of CF in a subject comprising the administration of a composition or formulation comprising a polynucleotide encoding CFTR to that subject (e.g., an mRNA encoding a CFTR polypeptide).

In some embodiments, the polynucleotides, pharmaceutical compositions and formulations of the present disclosure are used to reduce the level of a metabolite associated with CF (e.g., the substrate or product), the method comprising administering to the subject an effective amount of a polynucleotide encoding a CFTR polypeptide.

In some embodiments, the administration of an effective amount of a polynucleotide, pharmaceutical composition or formulation of the present disclosure reduces the levels of a biomarker of CF, e.g., intracellular sodium levels. In some embodiments, the administration of the polynucleotide, pharmaceutical composition or formulation of the present disclosure results in reduction in the level of one or more biomarkers of CF, e.g., intracellular sodium levels, within a short period of time after administration of the polynucleotide, pharmaceutical composition or formulation of the present disclosure.

Replacement therapy is a potential treatment for CF. Thus, in certain aspects of the present disclosure, the polynucleotides, e.g., mRNA, disclosed herein comprise one or more sequences encoding a CFTR polypeptide that is suitable for use in gene replacement therapy for CF. In some embodiments, the present disclosure treats a lack of CFTR or CFTR activity, or decreased or abnormal CFTR activity in a subject by providing a polynucleotide, e.g., mRNA, that encodes a CFTR polypeptide to the subject. In some embodiments, the polynucleotide is sequence-optimized. In some embodiments, the polynucleotide (e.g., an mRNA) comprises a nucleic acid sequence (e.g., an ORF) encoding a CFTR polypeptide, wherein the nucleic acid is sequence-optimized, e.g., by modifying its G/C, uridine, or thymidine content, and/or the polynucleotide comprises at least one chemically modified nucleoside. In some embodiments, the polynucleotide comprises a miRNA binding site, e.g., a miRNA binding site that binds miRNA-142.

In some embodiments, the administration of a composition or formulation comprising polynucleotide, pharmaceutical composition or formulation of the present disclosure to a subject results in a decrease in intracellular sodium levels in cells to a level at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or to 100% lower than the level observed prior to the administration of the composition or formulation.

In some embodiments, the administration of the polynucleotide, pharmaceutical composition or formulation of the present disclosure results in expression of CFTR in cells of the subject. In some embodiments, administering the polynucleotide, pharmaceutical composition or formulation of the present disclosure results in an increase of CFTR enzymatic activity in the subject. For example, in some embodiments, the polynucleotides of the present disclosure are used in methods of administering a composition or formulation comprising an mRNA encoding a CFTR polypeptide to a subject, wherein the method results in an increase of CFTR enzymatic activity in at least some cells of a subject.

In some embodiments, the administration of a composition or formulation comprising an mRNA encoding a CFTR polypeptide to a subject results in an increase of CFTR enzymatic activity in cells subject to a level at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or to 100% or more of the activity level expected in a normal subject, e.g., a human not suffering from CF.

In some embodiments, the administration of the polynucleotide, pharmaceutical composition or formulation of the present disclosure results in expression of CFTR protein in at least some of the cells of a subject that persists for a period of time sufficient to allow significant chrloride channel activity to occur.

In some embodiments, the expression of the encoded polypeptide is increased. In some embodiments, the polynucleotide increases CFTR expression levels in cells when introduced into those cells, e.g., by at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or to 100% with respect to the CFTR expression level in the cells before the polypeptide is introduced in the cells.

In some embodiments, the method or use comprises administering a polynucleotide, e.g., mRNA, comprising a nucleotide sequence having sequence similarity to a polynucleotide selected from the group of SEQ ID NOs: 5 to 54 (See Table 2; FIG. 10), wherein the polynucleotide encodes an CFTR polypeptide.

Other aspects of the present disclosure relate to transplantation of cells containing polynucleotides to a mammalian subject. Administration of cells to mammalian subjects is known to those of ordinary skill in the art, and includes, but is not limited to, local implantation (e.g., topical or subcutaneous administration), organ delivery or systemic injection (e.g., intravenous injection or inhalation), and the formulation of cells in pharmaceutically acceptable carriers.

24. Compositions and Formulations for Use

Certain aspects of the present disclosure are directed to compositions or formulations comprising any of the polynucleotides disclosed above.

In some embodiments, the composition or formulation comprises:
(i) a polynucleotide (e.g., a RNA, e.g., an mRNA) comprising a sequence-optimized nucleotide sequence (e.g., an ORF) encoding a CFTR polypeptide (e.g., the wild-type sequence, functional fragment, or variant thereof), wherein the polynucleotide comprises at least one chemically modified nucleobase, e.g., 5-methoxyuracil (e.g., wherein at least about 25%, at least about 30%, at least about 40%, at least about 50%, at least about 60%, at least about 70%, at least about 80%, at least about 90%, at least about 95%, at least about 99%, or 100% of the uracils are 5-methoxyuracils), and wherein the polynucleotide further comprises a miRNA binding site, e.g., a miRNA binding site that binds to miR-142 (e.g., a miR-142-3p or miR-142-5p binding site); and
(ii) a delivery agent comprising a compound having Formula (I), e.g., any of Compounds 1-147 (e.g., Compound 18, 25, 26 or 48) or any of Compounds 1-232, or a compound having Formula (III), (IV), (V), or (VI), e.g., any of Compounds 233-342 (e.g., Compound 236), or any PEG lipid Compounds of Formula (VIII), e.g., any of Compounds 419-428, e.g., Compound 428.

In some embodiments, the uracil or thymine content of the ORF relative to the theoretical minimum uracil or thymine content of a nucleotide sequence encoding the CFTR polypeptide (% $U_{TM}$ or % $T_{TM}$), is between about 100% and about 150%.

In some embodiments, the polynucleotides, compositions or formulations above are used to treat and/or prevent a CFTR-related diseases, disorders or conditions, e.g., CF.

25. Forms of Administration

The polynucleotides, pharmaceutical compositions and formulations of the present disclosure described above can be administered by any route that results in a therapeutically effective outcome. These include, but are not limited to enteral (into the intestine), gastroenteral, epidural (into the dura matter), oral (by way of the mouth), transdermal, peridural, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), in ear drops, auricular (in or by way of the ear), buccal (directed toward the cheek), conjunctival, cutaneous, dental (to a tooth or teeth), electro-osmosis, endocervical, endosinusial, endotracheal, extracorporeal, hemodialysis, infiltration, interstitial, intra-abdominal, intra-amniotic, intra-articular, intrabiliary, intrabronchial, intrabursal, intracartilaginous (within a cartilage), intracaudal (within the cauda equine), intracisternal (within the cisterna magna cerebellomedullaris), intracorneal (within the cornea), dental intracornal, intracoronary (within the coronary arteries), intracorporus cavernosum (within the dilatable spaces of the corporus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration that is then covered by a dressing that occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), intramyocardial (entering the myocardium), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis or spinal. In specific embodiments, compositions can be administered in a way that allows them cross the blood-brain barrier, vascular barrier, or other epithelial barrier. In some embodiments, a formulation for a route of administration can include at least one inactive ingredient.

The polynucleotides of the present disclosure (e.g., a polynucleotide comprising a nucleotide sequence encoding a CFTR polypeptide or a functional fragment or variant thereof) can be delivered to a cell naked. As used herein in, "naked" refers to delivering polynucleotides free from agents that promote transfection. The naked polynucleotides can be delivered to the cell using routes of administration known in the art and described herein.

The polynucleotides of the present disclosure (e.g., a polynucleotide comprising a nucleotide sequence encoding a CFTR polypeptide or a functional fragment or variant thereof) can be formulated, using the methods described herein. The formulations can contain polynucleotides that can be modified and/or unmodified. The formulations can further include, but are not limited to, cell penetration agents, a pharmaceutically acceptable carrier, a delivery agent, a bioerodible or biocompatible polymer, a solvent, and a sustained-release delivery depot. The formulated polynucleotides can be delivered to the cell using routes of administration known in the art and described herein.

A pharmaceutical composition for parenteral administration can comprise at least one inactive ingredient. Any or none of the inactive ingredients used can have been approved by the US Food and Drug Administration (FDA). A non-exhaustive list of inactive ingredients for use in pharmaceutical compositions for parenteral administration includes hydrochloric acid, mannitol, nitrogen, sodium acetate, sodium chloride and sodium hydroxide.

Injectable preparations, for example, sterile injectable aqueous or oleaginous suspensions can be formulated according to the known art using suitable dispersing agents, wetting agents, and/or suspending agents. Sterile injectable preparations can be sterile injectable solutions, suspensions, and/or emulsions in nontoxic parenterally acceptable diluents and/or solvents, for example, as a solution in 1,3-butanediol. Among the acceptable vehicles and solvents that can be employed are water, Ringer's solution, U.S.P., and isotonic sodium chloride solution. Sterile, fixed oils are conventionally employed as a solvent or suspending medium. For this purpose any bland fixed oil can be employed including synthetic mono- or diglycerides. Fatty acids such as oleic acid can be used in the preparation of injectables. The sterile formulation can also comprise adjuvants such as local anesthetics, preservatives and buffering agents.

Injectable formulations can be sterilized, for example, by filtration through a bacterial-retaining filter, and/or by incorporating sterilizing agents in the form of sterile solid compositions that can be dissolved or dispersed in sterile water or other sterile injectable medium prior to use.

Injectable formulations can be for direct injection into a region of a tissue, organ and/or subject. As a non-limiting example, a tissue, organ and/or subject can be directly injected a formulation by intramyocardial injection into the ischemic region. (See, e.g., Zangi et al. Nature Biotechnology 2013; the contents of which are herein incorporated by reference in its entirety).

In order to prolong the effect of an active ingredient, it is often desirable to slow the absorption of the active ingredient from subcutaneous or intramuscular injection. This can be accomplished by the use of a liquid suspension of crystalline or amorphous material with poor water solubility. The rate of absorption of the drug then depends upon its rate of dissolution which, in turn, can depend upon crystal size and crystalline form. Alternatively, delayed absorption of a parenterally administered drug form is accomplished by dissolving or suspending the drug in an oil vehicle. Injectable depot forms are made by forming microencapsule matrices of the drug in biodegradable polymers such as polylactide-polyglycolide. Depending upon the ratio of drug to polymer and the nature of the particular polymer employed, the rate of drug release can be controlled. Examples of other biodegradable polymers include poly (orthoesters) and poly(anhydrides). Depot injectable formulations are prepared by entrapping the drug in liposomes or microemulsions that are compatible with body tissues.

26. Kits and Devices a. Kits

The present disclosure provides a variety of kits for conveniently and/or effectively using the claimed nucleotides of the present disclosure. Typically kits will comprise sufficient amounts and/or numbers of components to allow a user to perform multiple treatments of a subject(s) and/or to perform multiple experiments.

In one aspect, the present disclosure provides kits comprising the molecules (polynucleotides) of the present disclosure.

Said kits can be for protein production, comprising a first polynucleotides comprising a translatable region. The kit can further comprise packaging and instructions and/or a delivery agent to form a formulation composition. The delivery agent can comprise a saline, a buffered solution, a lipidoid or any delivery agent disclosed herein.

In some embodiments, the buffer solution can include sodium chloride, calcium chloride, phosphate and/or EDTA. In another embodiment, the buffer solution can include, but is not limited to, saline, saline with 2 mM calcium, 5% sucrose, 5% sucrose with 2 mM calcium, 5% Mannitol, 5% Mannitol with 2 mM calcium, Ringer's lactate, sodium chloride, sodium chloride with 2 mM calcium and mannose (See, e.g., U.S. Pub. No. 20120258046; herein incorporated by reference in its entirety). In a further embodiment, the buffer solutions can be precipitated or it can be lyophilized. The amount of each component can be varied to enable consistent, reproducible higher concentration saline or simple buffer formulations. The components can also be varied in order to increase the stability of modified RNA in the buffer solution over a period of time and/or under a variety of conditions. In one aspect, the present disclosure provides kits for protein production, comprising: a polynucleotide comprising a translatable region, provided in an amount effective to produce a desired amount of a protein encoded by the translatable region when introduced into a target cell; a second polynucleotide comprising an inhibitory nucleic acid, provided in an amount effective to substantially inhibit the innate immune response of the cell; and packaging and instructions.

In one aspect, the present disclosure provides kits for protein production, comprising a polynucleotide comprising a translatable region, wherein the polynucleotide exhibits reduced degradation by a cellular nuclease, and packaging and instructions.

In one aspect, the present disclosure provides kits for protein production, comprising a polynucleotide comprising a translatable region, wherein the polynucleotide exhibits reduced degradation by a cellular nuclease, and a mammalian cell suitable for translation of the translatable region of the first nucleic acid.

b. Devices

The present disclosure provides for devices that can incorporate polynucleotides that encode polypeptides of interest. These devices contain in a stable formulation the reagents to synthesize a polynucleotide in a formulation available to be immediately delivered to a subject in need thereof, such as a human patient Devices for administration can be employed to deliver the polynucleotides of the present disclosure according to single, multi- or split-dosing regimens taught herein. Such devices are taught in, for example, International Application Publ. No. WO2013151666, the contents of which are incorporated herein by reference in their entirety.

Method and devices known in the art for multi-administration to cells, organs and tissues are contemplated for use in conjunction with the methods and compositions disclosed herein as embodiments of the present disclosure. These include, for example, those methods and devices having multiple needles, hybrid devices employing for example lumens or catheters as well as devices utilizing heat, electric current or radiation driven mechanisms.

According to the present disclosure, these multi-administration devices can be utilized to deliver the single, multi- or split doses contemplated herein. Such devices are taught for example in, International Application Publ. No. WO2013151666, the contents of which are incorporated herein by reference in their entirety.

In some embodiments, the polynucleotide is administered subcutaneously or intramuscularly via at least 3 needles to three different, optionally adjacent, sites simultaneously, or within a 60 minutes period (e.g., administration to 4, 5, 6, 7, 8, 9, or 10 sites simultaneously or within a 60 minute period).

c. Methods and Devices Utilizing Catheters and/or Lumens

Methods and devices using catheters and lumens can be employed to administer the polynucleotides of the present disclosure on a single, multi- or split dosing schedule. Such methods and devices are described in International Application Publication No. WO2013151666, the contents of which are incorporated herein by reference in their entirety.

d. Methods and Devices Utilizing Electrical Current

Methods and devices utilizing electric current can be employed to deliver the polynucleotides of the present disclosure according to the single, multi- or split dosing regimens taught herein. Such methods and devices are described in International Application Publication No. WO2013151666, the contents of which are incorporated herein by reference in their entirety.

28. Respiratory Function and Other Test for Improvement in CF Symptoms

In some embodiments, a pharmaceutical composition comprising an mRNA comprising an open reading frame (ORF) encoding a cystic fibrosis transmembrane conductance regulator (CFTR) polypeptide, when administered to a subject in need thereof, is sufficient to improve a measure of at least one respiratory volume by at least 10%, at least 15%, at least 20%, at least 25%, or at least 30% as compared to at least one reference respiratory volume measured in the subject untreated for cystic fibrosis, for at least 24 hours, at least 48 hours, at least 72 hours, at least 96 hours, or at least 120 hours post-administration. Respiratory volumes are the amount of air inhaled, exhaled and stored within the lungs at any given time. Non-limiting examples of various respiratory volumes that may be measured are provided below.

Total lung capacity (TLC) is the volume in the lungs at maximal inflation, the sum of VC and RV. The average total lung capacity is 6000 ml, although this varies with age, height, sex and health.

Tidal volume (TV) is the volume of air moved into or out of the lungs during quiet breathing (TV indicates a subdivision of the lung; when tidal volume is precisely measured, as in gas exchange calculation, the symbol TV or VT is used). The average tidal volume is 500 ml.

Residual volume (RV) is the volume of air remaining in the lungs after a maximal exhalation. Residual volume (RV/TLC %) is expressed as percent of TLC.

Expiratory reserve volume (ERV) is the maximal volume of air that can be exhaled (above tidal volume) during a forceful breath out.

Inspiratory reserve volume (IRV) is the maximal volume that can be inhaled from the end-inspiratory position.

Inspiratory capacity (IC) is the sum of IRV and TV.

Inspiratory vital capacity (IVC) is the maximum volume of air inhaled from the point of maximum expiration.

Vital capacity (VC) is the volume of air breathed out after the deepest inhalation.

Functional residual capacity (FRC) is the volume in the lungs at the end-expiratory position.

Forced vital capacity (FVC) is the determination of the vital capacity from a maximally forced expiratory effort.

Forced expiratory volume (time) (FEVt) is a generic term indicating the volume of air exhaled under forced conditions in the first t seconds. FEVi is the volume that has been exhaled at the end of the first second of forced expiration. FEF is the forced expiratory flow related to some portion of the FVC curve; modifiers refer to amount of FVC already exhaled. $FEF_{max}$ is the maximum instantaneous flow achieved during a FVC maneuver.

Forced inspiratory flow (FIF) is a specific measurement of the forced inspiratory curve, denoted by nomenclature analogous to that for the forced expiratory curve. For example, maximum inspiratory flow is denoted $FIF_{max}$. Unless otherwise specified, volume qualifiers indicate the volume inspired from RV at the point of measurement.

Peak expiratory flow (PEF) is the highest forced expiratory flow measured with a peak flow meter.

Maximal voluntary ventilation (MVV) is the volume of air expired in a specified period during repetitive maximal effort.

Additional Embodiments

The present disclosure encompasses the following embodiments, represented as numbered paragraphs:

1. A polynucleotide comprising an open reading frame (ORF) encoding a cystic fibrosis transmembrane conductance regulator (CFTR) polypeptide, wherein the uracil or thymine content of the ORF relative to the theoretical minimum uracil or thymine content of a nucleotide sequence encoding the CFTR polypeptide (% $U_{TM}$ or % $T_{TM}$) is between 100% and about 150%.
2. The polynucleotide of paragraph 1, wherein the % $U_{TM}$ or % $T_{TM}$ is between about 105% and about 145%, about 105% and about 140%, about 110% and about 140%, about 110% and about 145%, about 115% and about 135%, about 105% and about 135%, about 110% and about 135%, about 115% and about 145%, or about 115% and about 140%.
3. The polynucleotide of paragraph 2, wherein the % $U_{TM}$ or % $T_{TM}$ is between (i) 110%, 111%, 112%, 113%, 114%, 115%, 116%, 117%, 118%, or 119% and (ii) 120%, 121%, 122%, 123%, 124%, 125%, or 126%.
4. The polynucleotide of any one of paragraphs 1 to 3, wherein the uracil or thymine content in the ORF relative to the uracil or thymine content of the corresponding wild-type ORF (% $U_{WT}$ or % $T_{WT}$) is less than 100%.
5. The polynucleotide of paragraph 4, wherein the % $U_{WT}$ or % $T_{WT}$ is less than about 95%, less than about 90%, less than about 85%, less than 80%, less than 75%, less than 74%, less than 73%, less than 72%, less than 71%, less than 70%, less than 69%, or less than 68%.
6. The polynucleotide of paragraph 4, wherein the % $U_{WT}$ or % $T_{WT}$ is between 64% and 68% of the % $U_{WT}$ or % $T_{WT}$.
7. The polynucleotide of any one of paragraphs 1 to 6, wherein the uracil or thymine content in the ORF relative to the total nucleotide content in the ORF (% $U_{TL}$ or % $T_{TL}$) is less than about 50%, less than about 40%, less than about 30%, or less than about 20%.
8. The polynucleotide of paragraph 7, wherein the % $U_{TL}$ or % $T_{TL}$ is less than about 20%.
9. The polynucleotide of any one of paragraphs 1 to 8, wherein the % $U_{TL}$ or % $T_{TL}$ between about 17% and about 19%.
10. The polynucleotide of any one of paragraphs 1 to 9, wherein the guanine content in the ORF with respect to the theoretical maximum guanine content of a nucleotide sequence encoding the CFTR polypeptide (% $G_{TMX}$) is less than 100%, less than about 90%, less than about 85%, less than about 80%, or less than about 75%
11. The polynucleotide of paragraph 10, wherein the % $G_{TMX}$ is between about 70% and about 80%, between about 72% and about 78%, or between about 73% and about 77%.
12. The polynucleotide of any one of paragraphs 1 to 11, wherein the cytosine content of the ORF relative to the theoretical maximum cytosine content of a nucleotide sequence encoding the CFTR polypeptide (% $C_{TMX}$) is less than 95%.
13. The polynucleotide of paragraph 12, wherein the % $C_{TMX}$ is between about 60% and about 80%, between about 65% and about 75%, between about 67% and about 74%, or between about 69% and about 72%.
14. The polynucleotide of any one of paragraphs 1 to 13, wherein the guanine and cytosine content (G/C) of the ORF relative to the theoretical maximum G/C content in a nucleotide sequence encoding the CFTR polypeptide % $G/C_{TMX}$ is less than 100%, less than 99%, less than 98%, less than 97%, less than 96%, less than 95%, less than 94%, or less than 93%.
15. The polynucleotide of any one of paragraphs 1 to 13, wherein the % $G/C_{TMX}$ between about 80% and about 100%, between about 85% and about 99%, between about 90% and about 97%, or between about 91% and about 94%.
16. The polynucleotide of any one of paragraphs 1 to 15, wherein the G/C content in the ORF relative to the G/C content in the corresponding wild-type ORF (% $G/C_{WT}$) is at least 2%, at least 3%, at least 4%, at least 5%, at least 6%, at least 7%, at least about 10%, at least about 15%, at least about 20%, at least about 25%, at least about 30%, at least about 35%, or at least about 40% higher.
17. The polynucleotide of any one of paragraphs 1 to 15, wherein the average G/C content in the 3rd codon position in the ORF is at least 20%, at least 21%, at least 22%, at least 23%, at least 24%, at least 25%, at least 26%, at least 27%, at least 28%, at least 29%, or at least 30% higher than the average G/C content in the 3rd codon position in the corresponding wild-type ORF.
18. The polynucleotide of any one of paragraphs 1 to 17, wherein the ORF further comprises at least one low-frequency codon.
19. The polynucleotide of any one of paragraphs 1 to 18,
    (i) wherein the ORF is at least 91%, at least 92%, at least 93%, at least 94%, at least 95%, at least 96%, at least 97%, at least 98%, at least 99%, or 100% identical to CFTR-CO8, CFTR-CO33, CFTR-CO17, CFTR-CO42, CFTR-CO4, CFTR-CO29, CFTR-CO13, CFTR-CO38, CFTR-CO22, CFTR-CO5, CFTR-CO21, CFTR-CO30, CFTR-CO46, CFTR-CO47, CFTR-CO20, or CFTR-CO45;
    (ii) wherein the ORF is at least 90%, at least 91%, at least 92%, at least 93%, at least 94%, at least 95%, at least 96%, at least 97%, at least 98%, at least 99%, or 100% identical to CFTR-CO1, CFTR-CO26, CFTR-CO11, CFTR-CO36, CFTR-CO15, CFTR-CO24, CFTR-CO40, CFTR-CO49, CFTR-CO2, CFTR-CO19, CFTR-CO27, CFTR-CO44, CFTR-CO7, CFTR-CO32, CFTR-CO9, CFTR-CO34, CFTR-CO14, CFTR-CO39, CFTR-CO10, CFTR-CO35, CFTR-CO3, CFTR-CO28, CFTR-CO25, CFTR-CO50, CFTR-CO16, CFTR-CO41, CFTR-CO18, CFTR-CO43, CFTR-CO12, or CFTR-CO37; or (iii) wherein the ORF is at least 89%, at least 90%, at least 91%, at least 92%, at least 93%, at least 94%, at least 95%, at least 96%, at least 97%, at least 98%, at least 99%, or 100% identical to CFTR-CO23, CFTR-CO48, CFTR-CO6, or CFTR-CO31.

20. A polynucleotide comprising an ORF,
(i) wherein the ORF is at least 91%, at least 92%, at least 93%, at least 94%, at least 95%, at least 96%, at least 97%, at least 98%, at least 99%, or 100% identical to CFTR-CO8, CFTR-CO33, CFTR-CO17, CFTR-CO42, CFTR-CO4, CFTR-CO29, CFTR-CO13, CFTR-CO38, CFTR-CO22, CFTR-CO5, CFTR-CO21, CFTR-CO30, CFTR-CO46, CFTR-CO47, CFTR-CO20, or CFTR-CO45;
(ii) wherein the ORF is at least 90%, at least 91%, at least 92%, at least 93%, at least 94%, at least 95%, at least 96%, at least 97%, at least 98%, at least 99%, or 100% identical to CFTR-CO1, CFTR-CO26, CFTR-CO11, CFTR-CO36, CFTR-CO15, CFTR-CO24, CFTR-CO40, CFTR-CO49, CFTR-CO2, CFTR-CO19, CFTR-CO27, CFTR-CO44, CFTR-CO7, CFTR-CO32, CFTR-CO9, CFTR-CO34, CFTR-CO14, CFTR-CO39, CFTR-CO10, CFTR-CO35, CFTR-CO3, CFTR-CO28, CFTR-CO25, CFTR-CO50, CFTR-CO16, CFTR-CO41, CFTR-CO18, CFTR-CO43, CFTR-CO12, or CFTR-CO37; or
(iii) wherein the ORF is at least 89%, at least 90%, at least 91%, at least 92%, at least 93%, at least 94%, at least 95%, at least 96%, at least 97%, at least 98%, at least 99%, or 100% identical to CFTR-CO23, CFTR-CO48, CFTR-CO6, or CFTR-CO31.

21. The polynucleotide of any one of paragraphs 1 to 20, wherein the ORF has at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 5 to 54.

22. The polynucleotide of any one of paragraphs 1 to 21, wherein the CFTR polypeptide comprises an amino acid sequence at least at least about 89%, at least about 90%, at least about 91%, at least about 92%, at least about 93%, at least about 94%, about 95%, at least about 96%, at least about 97%, at least about 98%, at least about 99%, or about 100% identical to the polypeptide sequence of wild type CFTR (SEQ ID NO: 1), and wherein the CFTR polypeptide has chloride ion channel activity.

23. The polynucleotide of paragraph 22, wherein the CFTR polypeptide is a variant, derivative, or mutant having chloride ion channel activity.

24. The polynucleotide of any one of paragraphs 1 to 23, wherein the polynucleotide sequence further comprises a nucleotide sequence encoding a transit peptide.

25. The polynucleotide of any one of paragraphs 1 to 24, wherein the polynucleotide is single stranded.

26. The polynucleotide of any one of paragraphs 1 to 24, wherein the polynucleotide is double stranded.

27. The polynucleotide of any one of paragraphs 1 to 26, wherein the polynucleotide is DNA.

28. The polynucleotide of any one of paragraphs 1 to 26, wherein the polynucleotide is RNA.

29. The polynucleotide of paragraph 28, wherein the polynucleotide is mRNA.

30. The polynucleotide of any one of paragraphs 1 to 29, wherein the polynucleotide comprises at least one chemically modified nucleobase, sugar, backbone, or any combination thereof.

31. The polynucleotide of paragraph 30, wherein the at least one chemically modified nucleobase is selected from the group consisting of pseudouracil ($\psi$), N1-methylpseudouracil (m1$\psi$), 2-thiouracil (s2U), 4'-thiouracil, 5-methylcytosine,5-methyluracil, and any combinations thereof.

32. The polynucleotide of paragraph 30, wherein the at least one chemically modified nucleobase is 5-methoxyuracil.

33. The polynucleotide of paragraph 32, wherein at least about 25%, at least about 30%, at least about 40%, at least about 50%, at least about 60%, at least about 70%, at least about 80%, at least about 90%, at least about 95%, at least about 99%, or 100% of the uracils are 5-methoxyuracils.

34. The polynucleotide of any one of paragraphs 1 to 33, wherein the polynucleotide further comprises a miRNA binding site.

35. The polynucleotide of paragraph 34, wherein the miRNA binding site comprises one or more nucleotide sequences selected from Table 4.

36. The polynucleotide of paragraph 34, wherein the miRNA binding site binds to miR-142.

37. The polynucleotide of paragraph 35 or 36, wherein the miRNA binding site binds to miR-1-[2-3p or miR-142-5p.

38. The polynucleotide of paragraph 36 or 37, wherein the miR-142 comprises SEQ ID NO: 98.

39. The polynucleotide of any one of paragraphs 1 to 38, wherein the polynucleotide further comprises a 5' UTR.

40. The polynucleotide of paragraph 39, wherein the 5' UTR comprises a nucleic acid sequence at least 90%, at least about 95%, at least about 96%, at least about 97%, at least about 98%, at least about 99%, or about 100% identical to a 5' UTR sequence selected from the group consisting of SEQ ID NOs: 55-79.

41. The polynucleotide of any one of paragraphs 1 to 40, wherein the polynucleotide further comprises a 3' UTR.

42. The polynucleotide of paragraph 41, wherein the 3' UTR comprises a nucleic acid sequence at least about 90%, at least about 95%, at least about 96%, at least about 97%, at least about 98%, at least about 99%, or about 100% identical to a 3' UTR sequence selected from the group consisting of SEQ ID NOs: 80-97.

43. The polynucleotide of paragraph 41 or 42, wherein the miRNA binding site is located within the 3' UTR.

44. The polynucleotide of any one of paragraphs 1 to 43, wherein the polynucleotide further comprises a 5' terminal cap.

45. The polynucleotide of paragraph 44, wherein the 5' terminal cap comprises a Cap0, Cap1, ARCA, inosine, N1-methyl-guanosine, 2'-fluoro-guanosine, 7-deaza-guanosine, 8-oxo-guanosine, 2-amino-guanosine, LNA-guanosine, 2-azidoguanosine, Cap2, Cap4, 5' methylG cap, or an analog thereof.

46. The polynucleotide of any one of paragraphs 1 to 45, wherein the polynucleotide further comprises a poly-A region.

47. The polynucleotide of paragraph 46, wherein the poly-A region is at least about 10, at least about 20, at least about 30, at least about 40, at least about 50, at least about 60, at least about 70, at least about 80, or at least about 90 nucleotides in length.

48. The polynucleotide of paragraph 47, wherein the poly-A region has about 10 to about 200, about 20 to about 180, about 50 to about 160, about 70 to about 140, or about 80 to about 120 nucleotides in length.

49. The polynucleotide of any one of paragraphs 1 to 48, wherein the polynucleotide encodes a CFTR polypeptide that is fused to one or more heterologous polypeptides.

50. The polynucleotide of paragraph 49, wherein the one or more heterologous polypeptides increase a pharmacokinetic property of the CFTR polypeptide.

51. The polynucleotide of any one of paragraphs 1 to 50, wherein upon administration to a subject, the polynucleotide has:
   (i) a longer plasma half-life;
   (ii) increased expression of a CFTR polypeptide encoded by the ORF;
   (iii) a lower frequency of arrested translation resulting in an expression fragment;
   (iv) greater structural stability; or
   (v) any combination thereof,
   relative to a corresponding polynucleotide comprising SEQ ID NO: 2.

52. The polynucleotide of any one of paragraphs 1 to 51, wherein the polynucleotide comprises:
   (i) a 5'-terminal cap;
   (ii) a 5'-UTR;
   (iii) an ORF encoding a CFTR polypeptide;
   (iv) a 3'-UTR; and
   (v) a poly-A region.

53. The polynucleotide of paragraph 52, wherein the 3'-UTR comprises a miRNA binding site.

54. A method of producing the polynucleotide of any one of paragraphs 1 to 52, the method comprising modifying an ORF encoding a CFTR polypeptide by substituting at least one uracil nucleobase with an adenine, guanine, or cytosine nucleobase, or by substituting at least one adenine, guanine, or cytosine nucleobase with a uracil nucleobase, wherein all the substitutions are synonymous substitutions.

55. The method of paragraph 54, wherein the method further comprises replacing at least about 90%, at least about 95%, at least about 99%, or about 100% of uracils with 5-methoxyuracils.

56. A composition comprising
   (c) the polynucleotide of any one of paragraphs 1 to 53; and
   (d) a delivery agent.

57. The composition of paragraph 56, wherein the delivery agent comprises a lipidoid, a liposome, a lipoplex, a lipid nanoparticle, a polymeric compound, a peptide, a protein, a cell, a nanoparticle mimic, a nanotube, or a conjugate.

58. The composition of paragraph 56, wherein the delivery agent comprises a lipid nanoparticle.

59. The composition of paragraph 58, wherein the lipid nanoparticle comprises a lipid selected from the group consisting
of-(didodecylamino)-N1,N1,4-tridodecyl-1-piperazineethanamine (KL10),
N1-[2-(didodecylamino)ethyl]-N1,N4,N4-tridodecyl-1,4-piperazinediethanamine (KL22),
14,25-ditridecyl-15,18,21,24-tetraaza-octatriacontane (KL25),
1,2-dilinoleyloxy-N,N-dimethylaminopropane (DLinDMA),
2,2-dilinoleyl-4-dimethylaminomethyl-[1,3]-dioxolane (DLin-K-DMA),
heptatriaconta-6,9,28,31-tetraen-19-yl4-(dimethylamino) butanoate (DLin-MC3-DMA),
2,2-dilinoleyl-4-(2-dimethylaminoethyl)-[1,3]-dioxolane (DLin-KC2-DMA),
1,2-dioleyloxy-N,N-dimethylaminopropane (DODMA),
(13Z,16SZ)-N,N-dimethyl-3-nonydocosa-13-16-dien-1-amine (L608),
2-({8-[(3β)-cholest-5-en-3-yloxy]octyl}oxy)-N,N-dimethyl-3-[(9Z,12Z)-octadeca-9,12-dien-1-yl oxy]propan-1-amine (Octyl-CLinDMA),
(2R)-2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA (2R)),
(2S)-2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA (2S)), and any combinations thereof.

60. The composition of any one of paragraphs 56 to 59, wherein the delivery agent comprises a compound having the Formula (I)

$$\left(\begin{array}{c}R_4\diagdown N \diagup R_1 \\ R_5 \diagup \diagdown \\ R_6\end{array}\right)_m \begin{array}{c} R_2 \diagup R_7 \\ M \diagdown R_3, \end{array} \quad (I)$$

or a salt or stereoisomer thereof, wherein
   $R_1$ is selected from the group consisting of $C_{5-20}$ alkyl, $C_{5-20}$ alkenyl, —R*YR", —YR", and —R"M'R';
   $R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;
   $R_4$ is selected from the group consisting of a $C_{3-6}$ carbocycle, —(CH$_2$)$_n$Q, —(CH$_2$)$_n$CHQR, —CHQR, —CQ(R)$_2$, and unsubstituted $C_{1-6}$ alkyl, where Q is selected from a carbocycle, heterocycle,
   —OR, —O(CH$_2$)$_n$N(R)$_2$, —C(O)OR, —OC(O)R, —CX$_3$, —CX$_2$H, —CXH$_2$, —CN, —N(R)$_2$, —C(O)N(R)$_2$, —N(R)C(O)R, —N(R)S(O)$_2$R, —N(R)C(O)N(R)$_2$, —N(R)C(S)N(R)$_2$, and —C(R)N(R)$_2$C(O)OR, and each n is independently selected from 1, 2, 3, 4, and 5;
   each $R_5$ is independently selected from the group consisting of $C_{1-3}$ alkyl, $C_{2-3}$ alkenyl, and H;
   each $R_6$ is independently selected from the group consisting of $C_{1-3}$ alkyl, $C_{2-3}$ alkenyl, and H;
   M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, an aryl group, and a heteroaryl group;
   $R_7$ is selected from the group consisting of $C_{1-3}$ alkyl, $C_{2-3}$ alkenyl, and H;
   each R is independently selected from the group consisting of $C_{1-3}$ alkyl, $C_{2-3}$ alkenyl, and H;
   each R' is independently selected from the group consisting of $C_{1-18}$ alkyl, $C_{2-18}$ alkenyl, —R*YR", —YR", and H;
   each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;
each Y is independently a $C_{3-6}$ carbocycle;
each X is independently selected from the group consisting of F, Cl, Br, and I; and
m is selected from 5, 6, 7, 8, 9, 10, 11, 12, and 13; and
provided when $R_4$ is —$(CH_2)_nQ$, —$(CH_2)_nCHQR$, —CHQR, or —$CQ(R)_2$, then (i) Q is not —$N(R)_2$ when n is 1, 2, 3, 4 or 5, or (ii) Q is not 5, 6, or 7-membered heterocycloalkyl when n is 1 or 2.

61. A composition comprising a nucleotide sequence encoding a CFTR polypeptide and a delivery agent, wherein the delivery agent comprises a compound having the Formula (I)

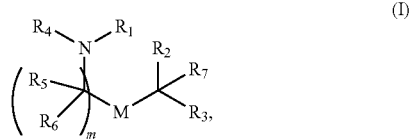
(I)

or a salt or stereoisomer thereof, wherein
$R_1$ is selected from the group consisting of $C_{5-20}$ alkyl, $C_{5-20}$ alkenyl, —R*YR", —YR", and —R"M'R';
$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;
$R_4$ is selected from the group consisting of a $C_{3-6}$ carbocycle, —$(CH_2)_nQ$, —$(CH_2)_nCHQR$, —CHQR, —$CQ(R)_2$, and unsubstituted $C_{1-6}$ alkyl, where Q is selected from a carbocycle, heterocycle, —OR, —$O(CH_2)_nN(R)_2$, —C(O)OR, —OC(O)R, —$CX_3$, —$CX_2H$, —$CXH_2$, —CN, —$N(R)_2$, —$C(O)N(R)_2$, —N(R)C(O)R, —$N(R)S(O)_2R$, —$N(R)C(O)N(R)_2$, —$N(R)C(S)N(R)_2$, and —$C(R)N(R)_2C(O)OR$, and each n is independently selected from 1, 2, 3, 4, and 5;
each $R_5$ is independently selected from the group consisting of $C_{1-3}$ alkyl, $C_{2-3}$ alkenyl, and H;
each $R_6$ is independently selected from the group consisting of $C_{1-3}$ alkyl, $C_{2-3}$ alkenyl, and H;
M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —$S(O)_2$—, an aryl group, and a heteroaryl group;
$R_7$ is selected from the group consisting of $C_{1-3}$ alkyl, $C_{2-3}$ alkenyl, and H;
each R is independently selected from the group consisting of $C_{1-3}$ alkyl, $C_{2-3}$ alkenyl, and H;
each R' is independently selected from the group consisting of $C_{1-18}$ alkyl, $C_{2-18}$ alkenyl, —R*YR", —YR", and H;
each R" is independently selected from the group consisting of $C_{3-14}$ alkyl and $C_{3-14}$ alkenyl;
each R* is independently selected from the group consisting of $C_{1-12}$ alkyl and $C_{2-12}$ alkenyl;
each Y is independently a $C_{3-6}$ carbocycle;
each X is independently selected from the group consisting of F, Cl, Br, and I; and
m is selected from 5, 6, 7, 8, 9, 10, 11, 12, and 13; and
provided when $R_4$ is —$(CH_2)_nQ$, —$(CH_2)_nCHQR$, —CHQR, or —$CQ(R)_2$, then (i) Q is not —$N(R)_2$ when n is 1, 2, 3, 4 or 5, or (ii) Q is not 5, 6, or 7-membered heterocycloalkyl when n is 1 or 2.

62. The composition of paragraph 60 or 61, wherein the compound is of Formula (IA):

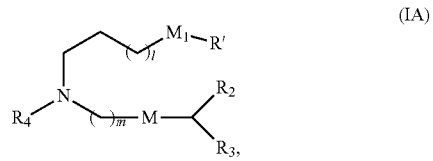
(IA)

or a salt or stereoisomer thereof, wherein
l is selected from 1, 2, 3, 4, and 5;
m is selected from 5, 6, 7, 8, and 9;
$M_1$ is a bond or M';
$R_4$ is unsubstituted $C_{1-3}$ alkyl, or —$(CH_2)_nQ$, in which n is 1, 2, 3, 4, or 5 and Q is OH, —$NHC(S)N(R)_2$, or —$NHC(O)N(R)_2$;
M and M' are independently selected from —C(O)O—, —OC(O)—, —C(O)N(R')—, —P(O)(OR')O—,
an aryl group, and a heteroaryl group; and
$R_2$ and $R_3$ are independently selected from the group consisting of H, $C_{1-14}$ alkyl, and $C_{2-14}$ alkenyl.

63. The composition of any one of paragraphs 60 to 62, wherein m is 5, 7, or 9.

64. The composition of any one of paragraphs 60 to 63, wherein the compound is of Formula (II):

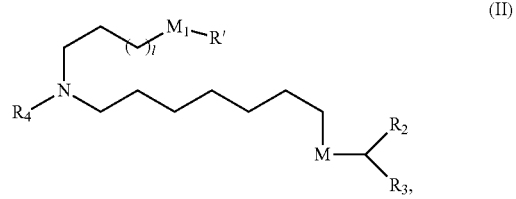
(II)

or a salt or stereoisomer thereof, wherein
l is selected from 1, 2, 3, 4, and 5;
$M_1$ is a bond or M';
$R_4$ is unsubstituted $C_{1-3}$ alkyl, or —$(CH_2)_nQ$, in which n is 2, 3, or 4 and Q is OH, —$NHC(S)N(R)_2$, or —$NHC(O)N(R)_2$;
M and M' are independently selected from —C(O)O—, —OC(O)—, —C(O)N(R')—, —P(O)(OR')O—,
an aryl group, and a heteroaryl group; and
$R_2$ and $R_3$ are independently selected from the group consisting of H, $C_{1-14}$ alkyl, and $C_{2-14}$ alkenyl.

65. The composition of any one of paragraphs 62 to 64, wherein $M_1$ is M'.

66. The composition of paragraph 65, wherein M and M' are independently —C(O)O— or —OC(O)—.

67. The composition of any one of paragraphs 62 to 66, wherein l is 1, 3, or 5.

68. The composition of paragraph 60 or 61, wherein the compound is selected from the group consisting of Compound 1 to Compound 232, salts and stereoisomers thereof, and any combination thereof.

69. The composition of paragraph 60 or 61, wherein the compound is of the Formula (IIa), (IIa)

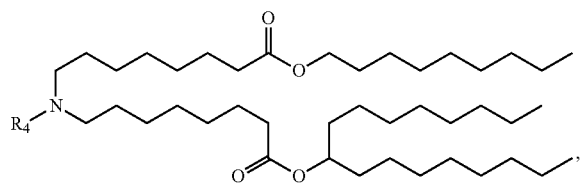

or a salt or stereoisomer thereof.

70. The composition of paragraph 60 or 61, wherein the compound is of the Formula (IIb), (IIb)

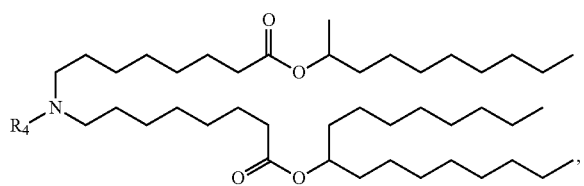

or a salt or stereoisomer thereof.

71. The composition of paragraph 60 or 61, wherein the compound is of the Formula (IIc) or (IIe), (IIc)

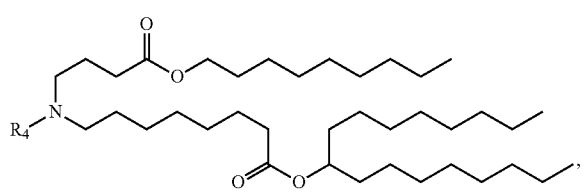

(IIe)

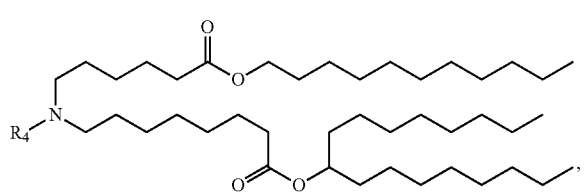

or a salt or stereoisomer thereof.

72. The composition of any one of paragraphs 69 to 71, wherein $R_4$ is selected from —$(CH_2)_nQ$ and —$(CH_2)_n$CHQR.

73. The composition of paragraph 60 or 61, wherein the compound is of the Formula (IId), (IId)

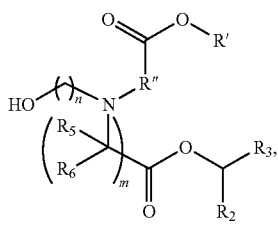

or a salt or stereoisomer thereof, wherein $R_2$ and $R_3$ are independently selected from the group consisting of $C_{5-14}$ alkyl and $C_{5-14}$ alkenyl, n is selected from 2, 3, and 4, and R', R", $R_5$, $R_6$ and m are as defined in paragraph 60 or 61.

74. The composition of paragraph 73, wherein $R_2$ is $C_8$ alkyl.
75. The composition of paragraph 74, wherein $R_3$ is $C_5$ alkyl, $C_6$ alkyl, $C_7$ alkyl, $C_8$ alkyl, or $C_9$ alkyl.
76. The composition of any one of paragraphs 73 to 75, wherein m is 5, 7, or 9.
77. The composition of any one of paragraphs 73 to 76, wherein each $R_5$ is H.
78. The composition of paragraph 77, wherein each $R_6$ is H.
79. The composition of any one of paragraphs 60 to 78, which is a nanoparticle composition.
80. The composition of paragraph 79, wherein the delivery agent further comprises a phospholipid.
81. The composition of paragraph 80, wherein the phospholipid is selected from the group consisting of 1,2-dilinoleoyl-sn-glycero-3-phosphocholine (DLPC), 1,2-dimyristoyl-sn-glycero-phosphocholine (DMPC), 1,2-dioleoyl-sn-glycero-3-phosphocholine (DOPC), 1,2-dipalmitoyl-sn-glycero-3-phosphocholine (DPPC), 1,2-distearoyl-sn-glycero-3-phosphocholine (DSPC), 1,2-diundecanoyl-sn-glycero-phosphocholine (DUPC), 1-palmitoyl-2-oleoyl-sn-glycero-3-phosphocholine (POPC), 1,2-di-O-octadecenyl-sn-glycero-3-phosphocholine (18:0 Diether PC), 1-oleoyl-2-cholesterylhemisuccinoyl-sn-glycero-3-phosphocholine (OChemsPC), 1-hexadecyl-sn-glycero-3-phosphocholine (C16 Lyso PC), 1,2-dilinolenoyl-sn-glycero-3-phosphocholine, 1,2-diarachidonoyl-sn-glycero-3-phosphocholine, 1,2-didocosahexaenoyl-sn-glycero-3-phosphocholine, 1,2-dioleoyl-sn-glycero-3-phosphoethanolamine (DOPE), 1,2-diphytanoyl-sn-glycero-3-phosphoethanolamine (ME 16:0 PE), 1,2-distearoyl-sn-glycero-3-phosphoethanolamine, 1,2-dilinoleoyl-sn-glycero-3-phosphoethanolamine, 1,2-dilinolenoyl-sn-glycero-3-phosphoethanolamine, 1,2-diarachidonoyl-sn-glycero-3-phosphoethanolamine, 1,2-didocosahexaenoyl-sn-glycero-3-phosphoethanolamine, 1,2-dioleoyl-sn-glycero-3-phospho-rac-(1-glycerol) sodium salt (DOPG), sphingomyelin, and any mixtures thereof.
82. The composition of any one of paragraphs 60 to 81, wherein the delivery agent further comprises a structural lipid.
83. The composition of paragraph 82, wherein the structural lipid is selected from the group consisting of cholesterol, fecosterol, sitosterol, ergosterol, campesterol, stigmasterol, brassicasterol, tomatidine, ursolic acid, alpha-tocopherol, and any mixtures thereof.
84. The composition of any one of paragraphs 60 to 83, wherein the delivery agent further comprises a PEG lipid.
85. The composition of paragraph 84, wherein the PEG lipid is selected from the group consisting of a PEG-modified phosphatidylethanolamine, a PEG-modified phosphatidic acid, a PEG-modified ceramide, a PEG-modified dialkylamine, a PEG-modified diacylglycerol, a PEG-modified dialkylglycerol, and any mixtures thereof.
86. The composition of any one of paragraphs 60 to 85, wherein the delivery agent further comprises an ionizable lipid selected from the group consisting of 3-(didodecylamino)-N1,N1,4-tridodecyl-1-piperazineethanamine (KL10),
N1-[2-(didodecylamino)ethyl]-N1,N4,N4-tridodecyl-1,4-piperazinediethanamine (KL22),
14,25-ditridecyl-15,18,21,24-tetraaza-octatriacontane (KL25),
1,2-dilinoleyloxy-N,N-dimethylaminopropane (DLin-DMA),
2,2-dilinoleyl-4-dimethylaminomethyl-[1,3]-dioxolane (DLin-K-DMA),
heptatriaconta-6,9,28,31-tetraen-19-yl 4-(dimethylamino)butanoate (DLin-MC3-DMA),
2,2-dilinoleyl-4-(2-dimethylaminoethyl)-[1,3]-dioxolane (DLin-KC2-DMA),
1,2-dioleyloxy-N,N-dimethylaminopropane (DODMA),
2-({8-[(3β)-cholest-5-en-3-yloxy]octyl}oxy)-N,N-dimethyl-3-[(9Z,12Z)-octadeca-9,12-dien-1-yl oxy]propan-1-amine (Octyl-CLinDMA),
(2R)-2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA (2R)), and
(2S)-2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA (2S)).

87. The composition of any one of paragraphs 60 to 86, wherein the delivery agent further comprises a phospholipid, a structural lipid, a PEG lipid, or any combination thereof.
88. The composition of any one of paragraphs 60 to 87, wherein the composition is formulated for in vivo delivery.
89. The composition according any one of paragraphs 60 to 88, which is formulated for intramuscular, subcutaneous, or intradermal delivery.
90. A host cell comprising the polynucleotide of any one of paragraphs 1 to 53.
91. The host cell of paragraph 90, wherein the host cell is a eukaryotic cell.
92. A vector comprising the polynucleotide of any one of paragraphs 1 to 53.
93. A method of making a polynucleotide comprising enzymatically or chemically synthesizing the polynucleotide of any one of paragraphs 1 to 53.
94. A polypeptide encoded by the polynucleotide of any one of paragraphs 1 to 53, the composition of any one of paragraphs 56 to 89, the host cell of paragraph 90 or 91, or the vector of paragraph 92 or produced by the method of paragraph 93.
95. A method of expressing in vivo an active CFTR polypeptide in a subject in need thereof comprising administering to the subject an effective amount of the polynucleotide of any one of paragraphs 1 to 53, the composition of any one of paragraphs 56 to 89, the host cell of paragraph 90 or 91, or the vector of paragraph 92.
96. A method of treating cystic fibrosis in a subject in need thereof comprising administering to the subject a therapeutically effective amount of the polynucleotide of any one of paragraphs 1 to 53, the composition of any one of paragraphs 56 to 89, the host cell of paragraph 90 or 91, or the vector of paragraph 92, wherein the administration alleviates the signs or symptoms of cystic fibrosis in the subject.
97. A method to prevent or delay the onset of cystic fibrosis signs or symptoms in a subject in need thereof comprising administering to the subject a prophylactically effective amount of the polynucleotide of any one of paragraphs 1 to 53, the composition of any one of paragraphs 56 to 89, the host cell of paragraph 90 or 91, or the vector of paragraph 92 before cystic fibrosis signs or symptoms manifest, wherein the administration prevents or delays the onset of cystic fibrosis signs or symptoms in the subject.
98. A method to ameliorate the signs or symptoms of cystic fibrosis in a subject in need thereof comprising administering to the subject a therapeutically effective amount of the polynucleotide of any one of paragraphs 1 to 53, the composition of any one of paragraphs 56 to 89, the host cell of paragraph 90 or 91, or the vector of paragraph 92 before cystic fibrosis or symptoms manifest, wherein the administration ameliorates cystic fibrosis signs or symptoms in the subject.

27. Definitions

In order that the present disclosure can be more readily understood, certain terms are first defined. As used in this application, except as otherwise expressly provided herein, each of the following terms shall have the meaning set forth below. Additional definitions are set forth throughout the application.

The present disclosure includes embodiments in which exactly one member of the group is present in, employed in, or otherwise relevant to a given product or process. The present disclosure includes embodiments in which more than one, or all of the group members are present in, employed in, or otherwise relevant to a given product or process.

In this specification and the appended claims, the singular forms "a", "an" and "the" include plural referents unless the context clearly dictates otherwise. The terms "a" (or "an"), as well as the terms "one or more," and "at least one" can be used interchangeably herein. In certain aspects, the term "a" or "an" means "single." In other aspects, the term "a" or "an" includes "two or more" or "multiple."

Furthermore, "and/or" where used herein is to be taken as specific disclosure of each of the two specified features or components with or without the other. Thus, the term "and/or" as used in a phrase such as "A and/or B" herein is intended to include "A and B," "A or B," "A" (alone), and "B" (alone). Likewise, the term "and/or" as used in a phrase such as "A, B, and/or C" is intended to encompass each of the following aspects: A, B, and C; A, B, or C; A or C; A or B; B or C; A and C; A and B; B and C; A (alone); B (alone); and C (alone).

Unless defined otherwise, all technical and scientific terms used herein have the same meaning as commonly understood by one of ordinary skill in the art to which this disclosure is related. For example, the Concise Dictionary of Biomedicine and Molecular Biology, Juo, Pei-Show, 2nd ed., 2002, CRC Press; The Dictionary of Cell and Molecular Biology, 3rd ed., 1999, Academic Press; and the Oxford Dictionary Of Biochemistry And Molecular Biology, Revised, 2000, Oxford University Press, provide one of skill with a general dictionary of many of the terms used in this disclosure.

Wherever aspects are described herein with the language "comprising," otherwise analogous aspects described in terms of "consisting of" and/or "consisting essentially of" are also provided.

Units, prefixes, and symbols are denoted in their Systeme International de Unites (SI) accepted form. Numeric ranges are inclusive of the numbers defining the range. Where a range of values is recited, it is to be understood that each intervening integer value, and each fraction thereof, between the recited upper and lower limits of that range is also specifically disclosed, along with each subrange between such values. The upper and lower limits of any range can independently be included in or excluded from the range, and each range where either, neither or both limits are included is also encompassed within the present disclosure. Where a value is explicitly recited, it is to be understood that values which are about the same quantity or amount as the recited value are also within the scope of the present disclosure. Where a combination is disclosed, each subcombination of the elements of that combination is also specifically disclosed and is within the scope of the present disclosure. Conversely, where different elements or groups of elements are individually disclosed, combinations thereof are also disclosed. Where any element of an present disclosure is disclosed as having a plurality of alternatives, examples of that present disclosure in which each alternative is excluded singly or in any combination with the other alternatives are also hereby disclosed; more than one element of an present disclosure can have such exclusions, and all combinations of elements having such exclusions are hereby disclosed.

Nucleotides are referred to by their commonly accepted single-letter codes. Unless otherwise indicated, nucleic acids are written left to right in 5' to 3' orientation. Nucleobases are referred to herein by their commonly known one-letter symbols recommended by the IUPAC-IUB Biochemical Nomenclature Commission. Accordingly, A represents adenine, C represents cytosine, G represents guanine, T represents thymine, U represents uracil.

Amino acids are referred to herein by either their commonly known three letter symbols or by the one-letter symbols recommended by the IUPAC-IUB Biochemical Nomenclature Commission. Unless otherwise indicated, amino acid sequences are written left to right in amino to carboxy orientation.

About: The term "about" as used in connection with a numerical value throughout the specification and the claims denotes an interval of accuracy, familiar and acceptable to a person skilled in the art. Such interval of accuracy is ±10%.

Where ranges are given, endpoints are included. Furthermore, unless otherwise indicated or otherwise evident from the context and understanding of one of ordinary skill in the art, values that are expressed as ranges can assume any specific value or subrange within the stated ranges in different embodiments of the present disclosure, to the tenth of the unit of the lower limit of the range, unless the context clearly dictates otherwise.

Administered in combination: As used herein, the term "administered in combination" or "combined administration" means that two or more agents are administered to a subject at the same time or within an interval such that there can be an overlap of an effect of each agent on the patient. In some embodiments, they are administered within about 60, 30, 15, 10, 5, or 1 minute of one another. In some embodiments, the administrations of the agents are spaced sufficiently closely together such that a combinatorial (e.g., a synergistic) effect is achieved.

Amino acid substitution: The term "amino acid substitution" refers to replacing an amino acid residue present in a parent or reference sequence (e.g., a wild type CFTR sequence) with another amino acid residue. An amino acid can be substituted in a parent or reference sequence (e.g., a wild type CFTR polypeptide sequence), for example, via chemical peptide synthesis or through recombinant methods known in the art. Accordingly, a reference to a "substitution at position X" refers to the substitution of an amino acid present at position X with an alternative amino acid residue. In some aspects, substitution patterns can be described according to the schema AnY, wherein A is the single letter code corresponding to the amino acid naturally or originally present at position n, and Y is the substituting amino acid residue. In other aspects, substitution patterns can be described according to the schema An(YZ), wherein A is the single letter code corresponding to the amino acid residue substituting the amino acid naturally or originally present at position X, and Y and Z are alternative substituting amino acid residue, i.e., In the context of the present disclosure, substitutions (even when they referred to as amino acid substitution) are conducted at the nucleic acid level, i.e., substituting an amino acid residue with an alternative amino acid residue is conducted by substituting the codon encoding the first amino acid with a codon encoding the second amino acid.

Animal: As used herein, the term "animal" refers to any member of the animal kingdom. In some embodiments, "animal" refers to humans at any stage of development. In some embodiments, "animal" refers to non-human animals at any stage of development. In certain embodiments, the non-human animal is a mammal (e.g., a rodent, a mouse, a rat, a rabbit, a monkey, a dog, a cat, a sheep, cattle, a primate, or a pig). In some embodiments, animals include, but are not limited to, mammals, birds, reptiles, amphibians, fish, and worms. In some embodiments, the animal is a transgenic animal, genetically-engineered animal, or a clone.

Approximately: As used herein, the term "approximately," as applied to one or more values of interest, refers to a value that is similar to a stated reference value. In certain embodiments, the term "approximately" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Associated with: As used herein with respect to a disease, the term "associated with" means that the symptom, measurement, characteristic, or status in question is linked to the diagnosis, development, presence, or progression of that disease. As association can, but need not, be causatively linked to the disease. For example, symptoms, sequelae, or any effects causing a decrease in the quality of life of a patient of CF are considered associated with CF and in some embodiments of the present disclosure can be treated, ameliorated, or prevented by administering the polynucleotides of the present disclosure to a subject in need thereof.

When used with respect to two or more moieties, the terms "associated with," "conjugated," "linked," "attached," and "tethered," when used with respect to two or more moieties, means that the moieties are physically associated or connected with one another, either directly or via one or more additional moieties that serves as a linking agent, to form a structure that is sufficiently stable so that the moieties remain physically associated under the conditions in which the structure is used, e.g., physiological conditions. An "association" need not be strictly through direct covalent chemical bonding. It can also suggest ionic or hydrogen bonding or a hybridization based connectivity sufficiently stable such that the "associated" entities remain physically associated.

Bifunctional: As used herein, the term "bifunctional" refers to any substance, molecule or moiety that is capable of or maintains at least two functions. The functions can affect the same outcome or a different outcome. The structure that produces the function can be the same or different. For example, bifunctional modified RNAs of the present disclosure can encode a CFTR peptide (a first function) while those nucleosides that comprise the encoding RNA are, in and of themselves, capable of extending the half-life of the RNA (second function). In this example, delivery of the bifunctional modified RNA to a subject suffereing from a protein defficiency would produce not only a peptide or protein molecule that can ameliorate or treat a disease or conditions, but would also maintain a population modified RNA present in the subject for a prolonged period of time. In other aspects, a bifunction modified mRNA can be a chimeric or quimeric molecule comprising, for example, an RNA encoding a CFTR peptide (a first function) and a second protein either fused to first protein or co-expressed with the first protein.

Biocompatible: As used herein, the term "biocompatible" means compatible with living cells, tissues, organs or systems posing little to no risk of injury, toxicity or rejection by the immune system.

Biodegradable: As used herein, the term "biodegradable" means capable of being broken down into innocuous products by the action of living things.

Biologically active: As used herein, the phrase "biologically active" refers to a characteristic of any substance that has activity in a biological system and/or organism. For instance, a substance that, when administered to an organism, has a biological effect on that organism, is considered to be biologically active. In particular embodiments, a polynucleotide of the present disclosure can be considered biologically active if even a portion of the polynucleotide is biologically active or mimics an activity considered biologically relevant.

Chimera: As used herein, "chimera" is an entity having two or more incongruous or heterogeneous parts or regions. For example, a chimeric molecule can comprise a first part comprising a CFTR polypeptide, and a second part (e.g., genetically fused to the first part) comprising a second therapeutic protein (e.g., a protein with a distinct enzymatic activity, an antigen binding moiety, or a moiety capable of extending the plasma half life of CFTR, for example, an Fc region of an antibody).

Sequence Optimization: The term "sequence optimization" refers to a process or series of processes by which nucleobases in a reference nucleic acid sequence are replaced with alternative nucleobases, resulting in a nucleic acid sequence with improved properties, e.g., improved protein expression or decreased immunogenicity.

In general, the goal in sequence optimization is to produce a synonymous nucleotide sequence than encodes the same polypeptide sequence encoded by the reference nucleotide sequence. Thus, there are no amino acid substitutions (as a result of codon optimization) in the polypeptide encoded by the codon optimized nucleotide sequence with respect to the polypeptide encoded by the reference nucleotide sequence.

Codon substitution: The terms "codon substitution" or "codon replacement" in the context of sequence optimization refer to replacing a codon present in a reference nucleic acid sequence with another codon. A codon can be substituted in a reference nucleic acid sequence, for example, via chemical peptide synthesis or through recombinant methods known in the art. Accordingly, references to a "substitution" or "replacement" at a certain location in a nucleic acid sequence (e.g., an mRNA) or within a certain region or subsequence of a nucleic acid sequence (e.g., an mRNA) refer to the substitution of a codon at such location or region with an alternative codon.

As used herein, the terms "coding region" and "region encoding" and grammatical variants thereof, refer to an Open Reading Frame (ORF) in a polynucleotide that upon expression yields a polypeptide or protein.

Compound: As used herein, the term "compound," is meant to include all stereoisomers and isotopes of the structure depicted. As used herein, the term "stereoisomer" means any geometric isomer (e.g., cis- and trans-isomer), enantiomer, or diastereomer of a compound. The present disclosure encompasses any and all stereoisomers of the compounds described herein, including stereomerically pure forms (e.g., geometrically pure, enantiomerically pure, or diastereomerically pure) and enantiomeric and stereoisomeric mixtures, e.g., racemates. Enantiomeric and stereomeric mixtures of compounds and means of resolving them into their component enantiomers or stereoisomers are well-known. "Isotopes" refers to atoms having the same atomic number but different mass numbers resulting from a different number of neutrons in the nuclei. For example, isotopes of hydrogen include tritium and deuterium. Further, a compound, salt, or complex of the present disclosure can be prepared in combination with solvent or water molecules to form solvates and hydrates by routine methods.

Contacting: As used herein, the term "contacting" means establishing a physical connection between two or more entities. For example, contacting a mammalian cell with a nanoparticle composition means that the mammalian cell and a nanoparticle are made to share a physical connection. Methods of contacting cells with external entities both in vivo and ex vivo are well known in the biological arts. For example, contacting a nanoparticle composition and a mammalian cell disposed within a mammal can be performed by varied routes of administration (e.g., intravenous, intramuscular, intradermal, and subcutaneous) and can involve varied amounts of nanoparticle compositions. Moreover, more than one mammalian cell can be contacted by a nanoparticle composition.

Conservative amino acid substitution: A "conservative amino acid substitution" is one in which the amino acid residue in a protein sequence is replaced with an amino acid residue having a similar side chain. Families of amino acid residues having similar side chains have been defined in the art, including basic side chains (e.g., lysine, arginine, or histidine), acidic side chains (e.g., aspartic acid or glutamic acid), uncharged polar side chains (e.g., glycine, asparagine, glutamine, serine, threonine, tyrosine, or cysteine), nonpolar side chains (e.g., alanine, valine, leucine, isoleucine, proline, phenylalanine, methionine, or tryptophan), beta-branched side chains (e.g., threonine, valine, isoleucine) and aromatic side chains (e.g., tyrosine, phenylalanine, tryptophan, or histidine). Thus, if an amino acid in a polypeptide is replaced with another amino acid from the same side chain family, the amino acid substitution is considered to be conservative. In another aspect, a string of amino acids can be conservatively replaced with a structurally similar string that differs in order and/or composition of side chain family members.

Non-conservative amino acid substitution: Non-conservative amino acid substitutions include those in which (i) a residue having an electropositive side chain (e.g., Arg, His or Lys) is substituted for, or by, an electronegative residue (e.g., Glu or Asp), (ii) a hydrophilic residue (e.g., Ser or Thr) is substituted for, or by, a hydrophobic residue (e.g., Ala, Leu, Ile, Phe or Val), (iii) a cysteine or proline is substituted for, or by, any other residue, or (iv) a residue having a bulky hydrophobic or aromatic side chain (e.g., Val, His, Ile or Trp) is substituted for, or by, one having a smaller side chain (e.g., Ala or Ser) or no side chain (e.g., Gly).

Other amino acid substitutions can be readily identified by workers of ordinary skill. For example, for the amino acid alanine, a substitution can be taken from any one of D-alanine, glycine, beta-alanine, L-cysteine and D-cysteine. For lysine, a replacement can be any one of D-lysine, arginine, D-arginine, homo-arginine, methionine, D-methionine, ornithine, or D-ornithine. Generally, substitutions in functionally important regions that can be expected to induce changes in the properties of isolated polypeptides are those in which (i) a polar residue, e.g., serine or threonine, is substituted for (or by) a hydrophobic residue, e.g., leucine, isoleucine, phenylalanine, or alanine; (ii) a cysteine residue is substituted for (or by) any other residue; (iii) a residue having an electropositive side chain, e.g., lysine, arginine or histidine, is substituted for (or by) a residue having an electronegative side chain, e.g., glutamic acid or aspartic acid; or (iv) a residue having a bulky side chain, e.g., phenylalanine, is substituted for (or by) one not having such a side chain, e.g., glycine. The likelihood that one of the foregoing non-conservative substitutions can alter functional properties of the protein is also correlated to the position of the substitution with respect to functionally important regions of the protein: some non-conservative substitutions can accordingly have little or no effect on biological properties.

Conserved: As used herein, the term "conserved" refers to nucleotides or amino acid residues of a polynucleotide sequence or polypeptide sequence, respectively, that are those that occur unaltered in the same position of two or more sequences being compared. Nucleotides or amino acids that are relatively conserved are those that are conserved amongst more related sequences than nucleotides or amino acids appearing elsewhere in the sequences.

In some embodiments, two or more sequences are said to be "completely conserved" if they are 100% identical to one another. In some embodiments, two or more sequences are said to be "highly conserved" if they are at least 70% identical, at least 80% identical, at least 90% identical, or at least 95% identical to one another. In some embodiments, two or more sequences are said to be "highly conserved" if they are about 70% identical, about 80% identical, about 90% identical, about 95%, about 98%, or about 99% identical to one another. In some embodiments, two or more sequences are said to be "conserved" if they are at least 30% identical, at least 40% identical, at least 50% identical, at least 60% identical, at least 70% identical, at least 80% identical, at least 90% identical, or at least 95% identical to one another. In some embodiments, two or more sequences are said to be "conserved" if they are about 30% identical, about 40% identical, about 50% identical, about 60% identical, about 70% identical, about 80% identical, about 90% identical, about 95% identical, about 98% identical, or about 99% identical to one another. Conservation of sequence can apply to the entire length of an polynucleotide or polypeptide or can apply to a portion, region or feature thereof.

Controlled Release: As used herein, the term "controlled release" refers to a pharmaceutical composition or compound release profile that conforms to a particular pattern of release to effect a therapeutic outcome.

Cyclic or Cyclized: As used herein, the term "cyclic" refers to the presence of a continuous loop. Cyclic molecules need not be circular, only joined to form an unbroken chain of subunits. Cyclic molecules such as the engineered RNA or mRNA of the present disclosure can be single units or multimers or comprise one or more components of a complex or higher order structure.

Cytotoxic: As used herein, "cytotoxic" refers to killing or causing injurious, toxic, or deadly effect on a cell (e.g., a mammalian cell (e.g., a human cell)), bacterium, virus, fungus, protozoan, parasite, prion, or a combination thereof.

Delivering: As used herein, the term "delivering" means providing an entity to a destination. For example, delivering a polynucleotide to a subject can involve administering a nanoparticle composition including the polynucleotide to the subject (e.g., by an intravenous, intramuscular, intradermal, or subcutaneous route). Administration of a nanoparticle composition to a mammal or mammalian cell can involve contacting one or more cells with the nanoparticle composition.

Delivery Agent: As used herein, "delivery agent" refers to any substance that facilitates, at least in part, the in vivo, in vitro, or ex vivo delivery of a polynucleotide to targeted cells.

Destabilized: As used herein, the term "destable," "destabilize," or "destabilizing region" means a region or molecule that is less stable than a starting, wild-type or native form of the same region or molecule.

Diastereomer: As used herein, the term "diastereomer," means stereoisomers that are not mirror images of one another and are non-superimposable on one another.

Digest: As used herein, the term "digest" means to break apart into smaller pieces or components. When referring to polypeptides or proteins, digestion results in the production of peptides.

Distal: As used herein, the term "distal" means situated away from the center or away from a point or region of interest.

Domain: As used herein, when referring to polypeptides, the term "domain" refers to a motif of a polypeptide having one or more identifiable structural or functional characteristics or properties (e.g., binding capacity, serving as a site for protein-protein interactions).

Dosing regimen: As used herein, a "dosing regimen" or a "dosing regimen" is a schedule of administration or physician determined regimen of treatment, prophylaxis, or palliative care.

Effective Amount: As used herein, the term "effective amount" of an agent is that amount sufficient to effect beneficial or desired results, for example, clinical results, and, as such, an "effective amount" depends upon the context in which it is being applied. For example, in the context of administering an agent that treats a protein deficiency (e.g., a CFTR deficiency), an effective amount of an agent is, for example, an amount of mRNA expressing sufficient CFTR to ameliorate, reduce, eliminate, or prevent the signs and symptoms associated with the CFTR deficiency, as compared to the severity of the symptom observed without administration of the agent. The term "effective amount" can be used interchangeably with "effective dose," "therapeutically effective amount," or "therapeutically effective dose."

Enantiomer: As used herein, the term "enantiomer" means each individual optically active form of a compound of the present disclosure, having an optical purity or enantiomeric excess (as determined by methods standard in the art) of at least 80% (i.e., at least 90% of one enantiomer and at most 10% of the other enantiomer), at least 90%, or at least 98%.

Encapsulate: As used herein, the term "encapsulate" means to enclose, surround or encase.

Encapsulation Efficiency: As used herein, "encapsulation efficiency" refers to the amount of a polynucleotide that becomes part of a nanoparticle composition, relative to the initial total amount of polynucleotide used in the preparation of a nanoparticle composition. For example, if 97 mg of polynucleotide are encapsulated in a nanoparticle composition out of a total 100 mg of polynucleotide initially provided to the composition, the encapsulation efficiency can be given as 97%. As used herein, "encapsulation" can refer to complete, substantial, or partial enclosure, confinement, surrounding, or encasement.

Encoded protein cleavage signal: As used herein, "encoded protein cleavage signal" refers to the nucleotide sequence that encodes a protein cleavage signal.

Engineered: As used herein, embodiments of the present disclosure are "engineered" when they are designed to have a feature or property, whether structural or chemical, that varies from a starting point, wild type or native molecule.

Enhanced Delivery: As used herein, the term "enhanced delivery" means delivery of more (e.g., at least 1.5 fold more, at least 2-fold more, at least 3-fold more, at least 4-fold more, at least 5-fold more, at least 6-fold more, at least 7-fold more, at least 8-fold more, at least 9-fold more, at least 10-fold more) of a polynucleotide by a nanoparticle to a target tissue of interest (e.g., mammalian liver) compared to the level of delivery of a polynucleotide by a control nanoparticle to a target tissue of interest (e.g., MC3, KC2, or DLinDMA). The level of delivery of a nanoparticle to a particular tissue can be measured by comparing the amount of protein produced in a tissue to the weight of said tissue, comparing the amount of polynucleotide in a tissue to the weight of said tissue, comparing the amount of protein produced in a tissue to the amount of total protein in said tissue, or comparing the amount of polynucleotide in a tissue to the amount of total polynucleotide in said tissue. It will be understood that the enhanced delivery of a nanoparticle to a target tissue need not be determined in a subject being treated, it can be determined in a surrogate such as an animal model (e.g., a rat model).

Exosome: As used herein, "exosome" is a vesicle secreted by mammalian cells or a complex involved in RNA degradation.

Expression: As used herein, "expression" of a nucleic acid sequence refers to one or more of the following events: (1) production of an mRNA template from a DNA sequence (e.g., by transcription); (2) processing of an mRNA transcript (e.g., by splicing, editing, 5' cap formation, and/or 3' end processing); (3) translation of an mRNA into a polypeptide or protein; and (4) post-translational modification of a polypeptide or protein.

Ex Vivo: As used herein, the term "ex vivo" refers to events that occur outside of an organism (e.g., animal, plant, or microbe or cell or tissue thereof). Ex vivo events can take place in an environment minimally altered from a natural (e.g., in vivo) environment.

Feature: As used herein, a "feature" refers to a characteristic, a property, or a distinctive element. When referring to polypeptides, "features" are defined as distinct amino acid sequence-based components of a molecule. Features of the polypeptides encoded by the polynucleotides of the present disclosure include surface manifestations, local conformational shape, folds, loops, half-loops, domains, half-domains, sites, termini or any combination thereof.

Formulation: As used herein, a "formulation" includes at least a polynucleotide and one or more of a carrier, an excipient, and a delivery agent.

Fragment: A "fragment," as used herein, refers to a portion. For example, fragments of proteins can comprise polypeptides obtained by digesting full-length protein isolated from cultured cells. In some embodiments, a fragment is a subsequences of a full length protein (e.g., CFTR) wherein N-terminal, and/or C-terminal, and/or internal subsequences have been deleted. In some preferred aspects of the present disclosure, the fragments of a protein of the present disclosure are functional fragments.

Functional: As used herein, a "functional" biological molecule is a biological molecule in a form in which it exhibits a property and/or activity by which it is characterized. Thus, a functional fragment of a polynucleotide of the present disclosure is a polynucleotide capable of expressing a functional CFTR fragment. As used herein, a functional fragment of CFTR refers to a fragment of wild type CFTR (i.e., a fragment of any of its naturally occurring isoforms), or a mutant or variant thereof, wherein the fragment retains a least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, or at least about 95% of the biological activity of the corresponding full length protein.

Helper Lipid: As used herein, the term "helper lipid" refers to a compound or molecule that includes a lipidic moiety (for insertion into a lipid layer, e.g., lipid bilayer) and a polar moiety (for interaction with physiologic solution at the surface of the lipid layer). Typically the helper lipid is a phospholipid. A function of the helper lipid is to "complement" the amino lipid and increase the fusogenicity of the bilayer and/or to help facilitate endosomal escape, e.g., of nucleic acid delivered to cells. Helper lipids are also believed to be a key structural component to the surface of the LNP.

Homology: As used herein, the term "homology" refers to the overall relatedness between polymeric molecules, e.g. between nucleic acid molecules (e.g. DNA molecules and/or RNA molecules) and/or between polypeptide molecules. Generally, the term "homology" implies an evolutionary relationship between two molecules. Thus, two molecules that are homologous will have a common evolutionary ancestor. In the context of the present disclosure, the term homology encompasses both to identity and similarity.

In some embodiments, polymeric molecules are considered to be "homologous" to one another if at least 25%, 30%, 35%, 40%, 45%, 50%, 55%, 60%, 65%, 70%, 75%, 80%, 85%, 90%, 95%, or 99% of the monomers in the molecule are identical (exactly the same monomer) or are similar (conservative substitutions). The term "homologous" necessarily refers to a comparison between at least two sequences (polynucleotide or polypeptide sequences).

Identity: As used herein, the term "identity" refers to the overall monomer conservation between polymeric molecules, e.g., between polynucleotide molecules (e.g. DNA molecules and/or RNA molecules) and/or between polypeptide molecules. Calculation of the percent identity of two polynucleotide sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. When comparing DNA and RNA, thymine (T) and uracil (U) can be considered equivalent.

Suitable software programs are available from various sources, and for alignment of both protein and nucleotide sequences. One suitable program to determine percent sequence identity is bl2seq, part of the BLAST suite of program available from the U.S. government's National Center for Biotechnology Information BLAST web site (blast.ncbi.nlm.nih.gov). Bl2seq performs a comparison between two sequences using either the BLASTN or BLASTP algorithm. BLASTN is used to compare nucleic acid sequences, while BLASTP is used to compare amino acid sequences. Other suitable programs are, e.g., Needle, Stretcher, Water, or Matcher, part of the EMBOSS suite of bioinformatics programs and also available from the European Bioinformatics Institute (EBI) at www.ebi.ac.uk/Tools/psa.

Sequence alignments can be conducted using methods known in the art such as MAFFT, Clustal (ClustalW, Clustal X or Clustal Omega), MUSCLE, etc.

Different regions within a single polynucleotide or polypeptide target sequence that aligns with a polynucleotide or polypeptide reference sequence can each have their own percent sequence identity. It is noted that the percent sequence identity value is rounded to the nearest tenth. For example, 80.11, 80.12, 80.13, and 80.14 are rounded down to 80.1, while 80.15, 80.16, 80.17, 80.18, and 80.19 are rounded up to 80.2. It also is noted that the length value will always be an integer.

In certain aspects, the percentage identity "% ID" of a first amino acid sequence (or nucleic acid sequence) to a second amino acid sequence (or nucleic acid sequence) is calculated as % ID=100×(Y/Z), where Y is the number of amino acid residues (or nucleobases) scored as identical matches in the alignment of the first and second sequences (as aligned by visual inspection or a particular sequence alignment program) and Z is the total number of residues in the second sequence. If the length of a first sequence is longer than the second sequence, the percent identity of the first sequence to the second sequence will be higher than the percent identity of the second sequence to the first sequence.

One skilled in the art will appreciate that the generation of a sequence alignment for the calculation of a percent sequence identity is not limited to binary sequence-sequence comparisons exclusively driven by primary sequence data. It will also be appreciated that sequence alignments can be generated by integrating sequence data with data from heterogeneous sources such as structural data (e.g., crystallographic protein structures), functional data (e.g., location of mutations), or phylogenetic data. A suitable program that integrates heterogeneous data to generate a multiple sequence alignment is T-Coffee, available at www.tcoffee.org, and alternatively available, e.g., from the EBI. It will also be appreciated that the final alignment used to calculate percent sequence identity can be curated either automatically or manually.

Immune response: The term "immune response" refers to the action of, for example, lymphocytes, antigen presenting cells, phagocytic cells, granulocytes, and soluble macromolecules produced by the above cells or the liver (including antibodies, cytokines, and complement) that results in selective damage to, destruction of, or elimination from the human body of invading pathogens, cells or tissues infected with pathogens, cancerous cells, or, in cases of autoimmunity or pathological inflammation, normal human cells or tissues. In some cases, the administration of a nanoparticle comprising a lipid component and an encapsulated therapeutic agent can trigger an immune response, which can be caused by (i) the encapsulated therapeutic agent (e.g., an mRNA), (ii) the expression product of such encapsulated therapeutic agent (e.g., a polypeptide encoded by the mRNA), (iii) the lipid component of the nanoparticle, or (iv) a combination thereof.

Inflammatory response: "Inflammatory response" refers to immune responses involving specific and non-specific defense systems. A specific defense system reaction is a specific immune system reaction to an antigen. Examples of specific defense system reactions include antibody responses. A non-specific defense system reaction is an inflammatory response mediated by leukocytes generally incapable of immunological memory, e.g., macrophages, eosinophils and neutrophils. In some aspects, an immune response includes the secretion of inflammatory cytokines, resulting in elevated inflammatory cytokine levels.

Inflammatory cytokines: The term "inflammatory cytokine" refers to cytokines that are elevated in an inflammatory response. Examples of inflammatory cytokines include interleukin-6 (IL-6), CXCL1 (chemokine (C-X-C motif) ligand 1; also known as GROα, interferon-γ (IFNγ), tumor necrosis factor α (TNFα), interferon γ-induced protein 10 (IP-10), or granulocyte-colony stimulating factor (G-CSF). The term inflammatory cytokines includes also other cytokines associated with inflammatory responses known in the art, e.g., interleukin-1 (IL-1), interleukin-8 (IL-8), interleukin-12 (IL-12), interleukin-13 (I1-13), interferon α (IFN-α), etc.

In Vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In Vivo: As used herein, the term "in vivo" refers to events that occur within an organism (e.g., animal, plant, or microbe or cell or tissue thereof).

Insertional and deletional variants: "Insertional variants" when referring to polypeptides are those with one or more amino acids inserted immediately adjacent to an amino acid at a particular position in a native or starting sequence. "Immediately adjacent" to an amino acid means connected to either the alpha-carboxy or alpha-amino functional group of the amino acid. "Deletional variants" when referring to polypeptides are those with one or more amino acids in the native or starting amino acid sequence removed. Ordinarily, deletional variants will have one or more amino acids deleted in a particular region of the molecule.

Intact: As used herein, in the context of a polypeptide, the term "intact" means retaining an amino acid corresponding to the wild type protein, e.g., not mutating or substituting the wild type amino acid. Conversely, in the context of a nucleic acid, the term "intact" means retaining a nucleobase corresponding to the wild type nucleic acid, e.g., not mutating or substituting the wild type nucleobase.

Ionizable amino lipid: The term "ionizable amino lipid" includes those lipids having one, two, three, or more fatty acid or fatty alkyl chains and a pH-titratable amino head group (e.g., an alkylamino or dialkylamino head group). An ionizable amino lipid is typically protonated (i.e., positively charged) at a pH below the pKa of the amino head group and is substantially not charged at a pH above the pKa. Such ionizable amino lipids include, but are not limited to DLin-MC3-DMA (MC3) and (13Z,165Z)-N,N-dimethyl-3-nonydocosa-13-16-dien-1-amine (L608).

Isolated: As used herein, the term "isolated" refers to a substance or entity that has been separated from at least some of the components with which it was associated (whether in nature or in an experimental setting). Isolated substances (e.g., polynucleotides or polypeptides) can have varying levels of purity in reference to the substances from which they have been isolated. Isolated substances and/or entities can be separated from at least about 10%, about 20%, about 30%, about 40%, about 50%, about 60%, about 70%, about 80%, about 90%, or more of the other components with which they were initially associated. In some embodiments, isolated substances are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components.

Substantially isolated: By "substantially isolated" is meant that the compound is substantially separated from the environment in which it was formed or detected. Partial separation can include, for example, a composition enriched in the compound of the present disclosure. Substantial separation can include compositions containing at least about 50%, at least about 60%, at least about 70%, at least about 80%, at least about 90%, at least about 95%, at least about 97%, or at least about 99% by weight of the compound of the present disclosure, or salt thereof.

A polynucleotide, vector, polypeptide, cell, or any composition disclosed herein which is "isolated" is a polynucleotide, vector, polypeptide, cell, or composition which is in a form not found in nature. Isolated polynucleotides, vectors, polypeptides, or compositions include those which have been purified to a degree that they are no longer in a form in which they are found in nature. In some aspects, a polynucleotide, vector, polypeptide, or composition which is isolated is substantially pure.

Isomer: As used herein, the term "isomer" means any tautomer, stereoisomer, enantiomer, or diastereomer of any compound of the present disclosure. It is recognized that the compounds of the present disclosure can have one or more chiral centers and/or double bonds and, therefore, exist as stereoisomers, such as double-bond isomers (i.e., geometric E/Z isomers) or diastereomers (e.g., enantiomers (i.e., (+) or (−)) or cis/trans isomers). According to the present disclosure, the chemical structures depicted herein, and therefore the compounds of the present disclosure, encompass all of the corresponding stereoisomers, that is, both the stereomerically pure form (e.g., geometrically pure, enantiomerically pure, or diastereomerically pure) and enantiomeric and stereoisomeric mixtures, e.g., racemates. Enantiomeric and stereoisomeric mixtures of compounds of the present disclosure can typically be resolved into their component enantiomers or stereoisomers by well-known methods, such as chiral-phase gas chromatography, chiral-phase high performance liquid chromatography, crystallizing the compound as a chiral salt complex, or crystallizing the compound in a chiral solvent. Enantiomers and stereoisomers can also be obtained from stereomerically or enantiomerically pure intermediates, reagents, and catalysts by well-known asymmetric synthetic methods.

Linker: As used herein, a "linker" refers to a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. The linker can be attached to a modified nucleoside or nucleotide on the nucleobase or sugar moiety at a first end, and to a payload, e.g., a detectable or therapeutic agent, at a second end. The linker can be of sufficient length as to not interfere with incorporation into a nucleic acid sequence. The linker can be used for any useful purpose, such as to form polynucleotide multimers (e.g., through linkage of two or more chimeric polynucleotides molecules or IVT polynucleotides) or polynucleotides conjugates, as well as to administer a payload, as described herein. Examples of chemical groups that can be incorporated into the linker include, but are not limited to, alkyl, alkenyl, alkynyl, amido, amino, ether, thioether, ester, alkylene, heteroalkylene, aryl, or heterocyclyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers and derivatives thereof, Other examples include, but are not limited to, cleavable moieties within the linker, such as, for example, a disulfide bond (—S—S—) or an azo bond (—N=N—), which can be cleaved using a reducing agent or photolysis. Non-limiting examples of a selectively cleavable bond include an amido bond can be cleaved for example by the use of tris(2-carboxyethyl)phosphine (TCEP), or other reducing agents, and/or photolysis, as well as an ester bond can be cleaved for example by acidic or basic hydrolysis.

Methods of Administration: As used herein, "methods of administration" can include intravenous, intramuscular, intradermal, subcutaneous, or other methods of delivering a composition to a subject. A method of administration can be selected to target delivery (e.g., to specifically deliver) to a specific region or system of a body.

Modified: As used herein "modified" refers to a changed state or structure of a molecule of the present disclosure. Molecules can be modified in many ways including chemically, structurally, and functionally. In some embodiments, the mRNA molecules of the present disclosure are modified by the introduction of non-natural nucleosides and/or nucleotides, e.g., as it relates to the natural ribonucleotides A, U, G, and C. Noncanonical nucleotides such as the cap structures are not considered "modified" although they differ from the chemical structure of the A, C, G, U ribonucleotides.

Mucus: As used herein, "mucus" refers to the natural substance that is viscous and comprises mucin glycoproteins.

Nanoparticle Composition: As used herein, a "nanoparticle composition" is a composition comprising one or more lipids. Nanoparticle compositions are typically sized on the order of micrometers or smaller and can include a lipid bilayer. Nanoparticle compositions encompass lipid nanoparticles (LNPs), liposomes (e.g., lipid vesicles), and lipoplexes. For example, a nanoparticle composition can be a liposome having a lipid bilayer with a diameter of 500 nm or less.

Naturally occurring: As used herein, "naturally occurring" means existing in nature without artificial aid.

Non-human vertebrate: As used herein, a "non-human vertebrate" includes all vertebrates except Homo sapiens, including wild and domesticated species. Examples of non-human vertebrates include, but are not limited to, mammals, such as alpaca, banteng, bison, camel, cat, cattle, deer, dog, donkey, gayal, goat, guinea pig, horse, llama, mule, pig, rabbit, reindeer, sheep water buffalo, and yak.

Nucleic acid sequence: The terms "nucleic acid sequence," "nucleotide sequence," or "polynucleotide sequence" are used interchangeably and refer to a contiguous nucleic acid sequence. The sequence can be either single stranded or double stranded DNA or RNA, e.g., an mRNA.

The term "nucleic acid," in its broadest sense, includes any compound and/or substance that comprises a polymer of nucleotides. These polymers are often referred to as polynucleotides. Exemplary nucleic acids or polynucleotides of the present disclosure include, but are not limited to, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization), ethylene nucleic acids (ENA), cyclohexenyl nucleic acids (CeNA) or hybrids or combinations thereof.

The phrase "nucleotide sequence encoding" refers to the nucleic acid (e.g., an mRNA or DNA molecule) coding sequence which encodes a polypeptide. The coding sequence can further include initiation and termination signals operably linked to regulatory elements including a promoter and polyadenylation signal capable of directing expression in the cells of an individual or mammal to which the nucleic acid is administered. The coding sequence can further include sequences that encode signal peptides.

Off-target: As used herein, "off target" refers to any unintended effect on any one or more target, gene, or cellular transcript.

Open reading frame: As used herein, "open reading frame" or "ORF" refers to a sequence which does not contain a stop codon in a given reading frame.

Operably linked: As used herein, the phrase "operably linked" refers to a functional connection between two or more molecules, constructs, transcripts, entities, moieties or the like.

Optionally substituted: Herein a phrase of the form "optionally substituted X" (e.g., optionally substituted alkyl) is intended to be equivalent to "X, wherein X is optionally substituted" (e.g., "alkyl, wherein said alkyl is optionally substituted"). It is not intended to mean that the feature "X" (e.g., alkyl) per se is optional.

Part: As used herein, a "part" or "region" of a polynucleotide is defined as any portion of the polynucleotide that is less than the entire length of the polynucleotide.

Patient: As used herein, "patient" refers to a subject who can seek or be in need of treatment, requires treatment, is receiving treatment, will receive treatment, or a subject who is under care by a trained professional for a particular disease or condition.

CFTR Associated Disease: As use herein the terms "CFTR-associated disease" or "CFTR-associated disorder" refer to diseases or disorders, respectively, which result from aberrant CFTR activity (e.g., decreased activity or increased activity). As a non-limiting example, cystic fibrosis is a CFTR associated disease. Numerous clinical variants of cystic fibrosis are know in the art. See, e.g., www.omim.org/entry/219700.

The terms "CFTR enzymatic activity," "CFTR activity," and "cystic fibrosis transmembrane conductance regulator activity" are used interchangeably in the present disclosure and refer to CFTR's ability to transport chrloride ions through the cellular membrane. Accordingly, a fragment or variant retaining or having CFTR enzymatic activity or CFTR activity refers to a fragment or variant that has measurable chloride transport across the cell membrane.

Pharmaceutically acceptable: The phrase "pharmaceutically acceptable" is employed herein to refer to those compounds, materials, compositions, and/or dosage forms that are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable excipients: The phrase "pharmaceutically acceptable excipient," as used herein, refers any ingredient other than the compounds described herein (for example, a vehicle capable of suspending or dissolving the active compound) and having the properties of being substantially nontoxic and non-inflammatory in a patient. Excipients can include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspending or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, crosslinked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

Pharmaceutically acceptable salts: The present disclosure also includes pharmaceutically acceptable salts of the compounds described herein. As used herein, "pharmaceutically acceptable salts" refers to derivatives of the disclosed compounds wherein the parent compound is modified by converting an existing acid or base moiety to its salt form (e.g., by reacting the free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, acetic acid, adipate, alginate, ascorbate, aspartate, benzenesulfonate, benzene sulfonic acid, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. The pharmaceutically acceptable salts of the present disclosure include the conventional non-toxic salts of the parent compound formed, for example, from non-toxic inorganic or organic acids. The pharmaceutically acceptable salts of the present disclosure can be synthesized from the parent compound that contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are used. Lists of suitable salts are found in Remington's Pharmaceutical Sciences, 17th ed., Mack Publishing Company, Easton, Pa., 1985, p. 1418, Pharmaceutical Salts: Properties, Selection, and Use, P. H. Stahl and C. G. Wermuth (eds.), Wiley-VCH, 2008, and Berge et al., Journal of Pharmaceutical Science, 66, 1-19 (1977), each of which is incorporated herein by reference in its entirety.

Pharmaceutically acceptable solvate: The term "pharmaceutically acceptable solvate," as used herein, means a compound of the present disclosure wherein molecules of a suitable solvent are incorporated in the crystal lattice. A suitable solvent is physiologically tolerable at the dosage administered. For example, solvates can be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N,N'-dimethylformamide (DMF), N,N'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate."

Pharmacokinetic: As used herein, "pharmacokinetic" refers to any one or more properties of a molecule or compound as it relates to the determination of the fate of substances administered to a living organism. Pharmacokinetics is divided into several areas including the extent and rate of absorption, distribution, metabolism and excretion. This is commonly referred to as ADME where: (A) Absorption is the process of a substance entering the blood circulation; (D) Distribution is the dispersion or dissemination of substances throughout the fluids and tissues of the body; (M) Metabolism (or Biotransformation) is the irreversible transformation of parent compounds into daughter metabolites; and (E) Excretion (or Elimination) refers to the elimination of the substances from the body. In rare cases, some drugs irreversibly accumulate in body tissue.

Physicochemical: As used herein, "physicochemical" means of or relating to a physical and/or chemical property.

Polynucleotide: The term "polynucleotide" as used herein refers to polymers of nucleotides of any length, including ribonucleotides, deoxyribonucleotides, analogs thereof, or mixtures thereof. This term refers to the primary structure of the molecule. Thus, the term includes triple-, double- and single-stranded deoxyribonucleic acid ("DNA"), as well as triple-, double- and single-stranded ribonucleic acid ("RNA"). It also includes modified, for example by alkylation, and/or by capping, and unmodified forms of the polynucleotide. More particularly, the term "polynucleotide" includes polydeoxyribonucleotides (containing 2-deoxy-D-ribose), polyribonucleotides (containing D-ribose), including tRNA, rRNA, hRNA, siRNA and mRNA, whether spliced or unspliced, any other type of polynucleotide which is an N- or C-glycoside of a purine or pyrimidine base, and other polymers containing normucleotidic backbones, for example, polyamide (e.g., peptide nucleic acids "PNAs") and polymorpholino polymers, and other synthetic sequence-specific nucleic acid polymers providing that the polymers contain nucleobases in a configuration which allows for base pairing and base stacking, such as is found in DNA and RNA. In particular aspects, the polynucleotide comprises an mRNA. In other aspect, the mRNA is a synthetic mRNA. In some aspects, the synthetic mRNA comprises at least one unnatural nucleobase. In some aspects, all nucleobases of a certain class have been replaced with unnatural nucleobases (e.g., all uridines in a polynucleotide disclosed herein can be replaced with an unnatural nucleobase, e.g., 5-methoxyuridine). In some aspects, the polynucleotide (e.g., a synthetic RNA or a synthetic DNA) comprises only natural nucleobases, i.e., A (adenosine), G (guanosine), C (cytidine), and T (thymidine) in the case of a synthetic DNA, or A, C, G, and U (uridine) in the case of a synthetic RNA.

The skilled artisan will appreciate that the T bases in the codon maps disclosed herein are present in DNA, whereas the T bases would be replaced by U bases in corresponding RNAs. For example, a codon-nucleotide sequence disclosed herein in DNA form, e.g., a vector or an in-vitro translation (IVT) template, would have its T bases transcribed as U based in its corresponding transcribed mRNA. In this respect, both codon-optimized DNA sequences (comprising T) and their corresponding mRNA sequences (comprising U) are considered codon-optimized nucleotide sequence of the present disclosure. A skilled artisan would also understand that equivalent codon-maps can be generated by replaced one or more bases with non-natural bases. Thus, e.g., a TTC codon (DNA map) would correspond to a UUC codon (RNA map), which in turn would correspond to a ΨΨC codon (RNA map in which U has been replaced with pseudouridine).

Standard A-T and G-C base pairs form under conditions which allow the formation of hydrogen bonds between the N3-H and $C_4$-oxy of thymidine and the N1 and C6-NH2, respectively, of adenosine and between the C2-oxy, N3 and C4-NH2, of cytidine and the C2-NH2, N'—H and C6-oxy, respectively, of guanosine. Thus, for example, guanosine (2-amino-6-oxy-9-β-D-ribofuranosyl-purine) can be modified to form isoguanosine (2-oxy-6-amino-9-β-D-ribofuranosyl-purine). Such modification results in a nucleoside base which will no longer effectively form a standard base pair with cytosine. However, modification of cytosine (1-β-D-ribofuranosyl-2-oxy-4-amino-pyrimidine) to form isocytosine (1-β-D-ribofuranosyl-2-amino-4-oxy-pyrimidine-) results in a modified nucleotide which will not effectively base pair with guanosine but will form a base pair with isoguanosine (U.S. Pat. No. 5,681,702 to Collins et al.). Isocytosine is available from Sigma Chemical Co. (St. Louis, Mo.); isocytidine can be prepared by the method described by Switzer et al. (1993) Biochemistry 32:10489-10496 and references cited therein; 2'-deoxy-5-methyl-isocytidine can be prepared by the method of Tor et al., 1993, J. Am. Chem. Soc. 115:4461-4467 and references cited therein; and isoguanine nucleotides can be prepared using the method described by Switzer et al., 1993, supra, and Mantsch et al., 1993, Biochem. 14:5593-5601, or by the method described in U.S. Pat. No. 5,780,610 to Collins et al. Other nonnatural base pairs can be synthesized by the method described in Piccirilli et al., 1990, Nature 343:33-37, for the synthesis of 2,6-diaminopyrimidine and its complement (1-methylpyrazolo-[4,3]pyrimidine-5,7-(4H,6H)-dione. Other such modified nucleotide units which form unique base pairs are known, such as those described in Leach et al. (1992) J. Am. Chem. Soc. 114:3675-3683 and Switzer et al., supra.

Polypeptide: The terms "polypeptide," "peptide," and "protein" are used interchangeably herein to refer to polymers of amino acids of any length. The polymer can comprise modified amino acids. The terms also encompass an amino acid polymer that has been modified naturally or by intervention; for example, disulfide bond formation, glycosylation, lipidation, acetylation, phosphorylation, or any other manipulation or modification, such as conjugation with a labeling component. Also included within the definition are, for example, polypeptides containing one or more analogs of an amino acid (including, for example, unnatural amino acids such as homocysteine, ornithine, p-acetylphenylalanine, D-amino acids, and creatine), as well as other modifications known in the art.

The term, as used herein, refers to proteins, polypeptides, and peptides of any size, structure, or function. Polypeptides include encoded polynucleotide products, naturally occurring polypeptides, synthetic polypeptides, homologs, orthologs, paralogs, fragments and other equivalents, variants, and analogs of the foregoing. A polypeptide can be a monomer or can be a multi-molecular complex such as a dimer, trimer or tetramer. They can also comprise single chain or multichain polypeptides. Most commonly disulfide linkages are found in multichain polypeptides. The term polypeptide can also apply to amino acid polymers in which one or more amino acid residues are an artificial chemical analogue of a corresponding naturally occurring amino acid. In some embodiments, a "peptide" can be less than or equal to 50 amino acids long, e.g., about 5, 10, 15, 20, 25, 30, 35, 40, 45, or 50 amino acids long.

Polypeptide variant: As used herein, the term "polypeptide variant" refers to molecules that differ in their amino acid sequence from a native or reference sequence. The amino acid sequence variants can possess substitutions, deletions, and/or insertions at certain positions within the amino acid sequence, as compared to a native or reference sequence. Ordinarily, variants will possess at least about 50% identity, at least about 60% identity, at least about 70% identity, at least about 80% identity, at least about 90% identity, at least about 95% identity, at least about 99% identity to a native or reference sequence. In some embodiments, they will be at least about 80%, or at least about 90% identical to a native or reference sequence.

Polypeptide per unit drug (PUD): As used herein, a PUD or product per unit drug, is defined as a subdivided portion of total daily dose, usually 1 mg, pg, kg, etc., of a product (such as a polypeptide) as measured in body fluid or tissue, usually defined in concentration such as pmol/mL, mmol/mL, etc. divided by the measure in the body fluid.

Preventing: As used herein, the term "preventing" refers to partially or completely delaying onset of an infection, disease, disorder and/or condition; partially or completely delaying onset of one or more signs and symptoms, features, or clinical manifestations of a particular infection, disease, disorder, and/or condition; partially or completely delaying onset of one or more signs and symptoms, features, or manifestations of a particular infection, disease, disorder, and/or condition; partially or completely delaying progression from an infection, a particular disease, disorder and/or condition; and/or decreasing the risk of developing pathology associated with the infection, the disease, disorder, and/or condition.

Proliferate: As used herein, the term "proliferate" means to grow, expand or increase or cause to grow, expand or increase rapidly. "Proliferative" means having the ability to proliferate. "Anti-proliferative" means having properties counter to or inapposite to proliferative properties.

Prophylactic: As used herein, "prophylactic" refers to a therapeutic or course of action used to prevent the spread of disease.

Prophylaxis: As used herein, a "prophylaxis" refers to a measure taken to maintain health and prevent the spread of disease. An "immune prophylaxis" refers to a measure to produce active or passive immunity to prevent the spread of disease.

Protein cleavage site: As used herein, "protein cleavage site" refers to a site where controlled cleavage of the amino acid chain can be accomplished by chemical, enzymatic or photochemical means.

Protein cleavage signal: As used herein "protein cleavage signal" refers to at least one amino acid that flags or marks a polypeptide for cleavage.

Protein of interest: As used herein, the terms "proteins of interest" or "desired proteins" include those provided herein and fragments, mutants, variants, and alterations thereof.

Proximal: As used herein, the term "proximal" means situated nearer to the center or to a point or region of interest.

Pseudouridine: As used herein, pseudouridine ($\psi$) refers to the C-glycoside isomer of the nucleoside uridine. A "pseudouridine analog" is any modification, variant, isoform or derivative of pseudouridine. For example, pseudouridine analogs include but are not limited to 1-carboxymethyl-pseudouridine, 1-propynyl-pseudouridine, 1-taurinomethyl-pseudouridine, 1-taurinomethyl-4-thio-pseudouridine, 1-methylpseudouridine ($m^1\psi$), 1-methyl-4-thio-pseudouridine ($m^1s^4\psi$), 4-thio-1-methyl-pseudouridine, 3-methyl-pseudouridine ($m^3\psi$), 2-thio-1-methyl-pseudouridine, 1-methyl-1-deaza-pseudouridine, 2-thio-1-methyl-1-deaza-pseudouridine, dihydropseudouridine, 2-thio-dihydropseudouridine, 2-methoxyuridine, 2-methoxy-4-thio-uridine, 4-methoxy-pseudouridine, 4-methoxy-2-thio-pseudouridine, N1-methyl-pseudouridine, 1-methyl-3-(3-amino-3-carboxypropyl)pseudouridine ($acp^3\psi$), and 2'-O-methyl-pseudouridine ($\psi$).

Purified: As used herein, "purify," "purified," "purification" means to make substantially pure or clear from unwanted components, material defilement, admixture or imperfection.

Reference Nucleic Acid Sequence: The term "reference nucleic acid sequence" or "reference nucleic acid" or "reference nucleotide sequence" or "reference sequence" refers to a starting nucleic acid sequence (e.g., a RNA, e.g., an mRNA sequence) that can be sequence optimized. In some embodiments, the reference nucleic acid sequence is a wild type nucleic acid sequence, a fragement or a variant thereof. In some embodiments, the reference nucleic acid sequence is a previously sequence optimized nucleic acid sequence.

Salts: In some aspects, the pharmaceutical composition disclosed herein and comprises salts of some of their lipid constituents. The term "salt" includes any anionic and cationic complex. Non-limiting examples of anions include inorganic and organic anions, e.g., fluoride, chloride, bromide, iodide, oxalate (e.g., hemioxalate), phosphate, phosphonate, hydrogen phosphate, dihydrogen phosphate, oxide, carbonate, bicarbonate, nitrate, nitrite, nitride, bisulfite, sulfide, sulfite, bisulfate, sulfate, thiosulfate, hydrogen sulfate, borate, formate, acetate, benzoate, citrate, tartrate, lactate, acrylate, polyacrylate, fumarate, maleate, itaconate, glycolate, gluconate, malate, mandelate, tiglate, ascorbate, salicylate, polymethacrylate, perchlorate, chlorate, chlorite, hypochlorite, bromate, hypobromite, iodate, an alkylsulfonate, an arylsulfonate, arsenate, arsenite, chromate, dichromate, cyanide, cyanate, thiocyanate, hydroxide, peroxide, permanganate, and mixtures thereof.

Sample: As used herein, the term "sample" or "biological sample" refers to a subset of its tissues, cells or component parts (e.g., body fluids, including but not limited to blood, mucus, lymphatic fluid, synovial fluid, cerebrospinal fluid, saliva, amniotic fluid, amniotic cord blood, urine, vaginal fluid and semen). A sample further can include a homogenate, lysate or extract prepared from a whole organism or a subset of its tissues, cells or component parts, or a fraction or portion thereof, including but not limited to, for example, plasma, serum, spinal fluid, lymph fluid, the external sections of the skin, respiratory, intestinal, and genitourinary tracts, tears, saliva, milk, blood cells, tumors, organs. A sample further refers to a medium, such as a nutrient broth or gel, which can contain cellular components, such as proteins or nucleic acid molecule.

Signal Sequence: As used herein, the phrases "signal sequence," "signal peptide," and "transit peptide" are used interchangeably and refer to a sequence that can direct the transport or localization of a protein to a certain organelle, cell compartment, or extracellular export. The term encompasses both the signal sequence polypeptide and the nucleic acid sequence encoding the signal sequence. Thus, references to a signal sequence in the context of a nucleic acid refer in fact to the nucleic acid sequence encoding the signal sequence polypeptide.

Signal transduction pathway: A "signal transduction pathway" refers to the biochemical relationship between a variety of signal transduction molecules that play a role in the transmission of a signal from one portion of a cell to another portion of a cell. As used herein, the phrase "cell surface receptor" includes, for example, molecules and complexes of molecules capable of receiving a signal and the transmission of such a signal across the plasma membrane of a cell.

Similarity: As used herein, the term "similarity" refers to the overall relatedness between polymeric molecules, e.g. between polynucleotide molecules (e.g. DNA molecules and/or RNA molecules) and/or between polypeptide molecules. Calculation of percent similarity of polymeric molecules to one another can be performed in the same manner as a calculation of percent identity, except that calculation of percent similarity takes into account conservative substitutions as is understood in the art.

Single unit dose: As used herein, a "single unit dose" is a dose of any therapeutic administered in one dose/at one time/single route/single point of contact, i.e., single administration event.

Split dose: As used herein, a "split dose" is the division of single unit dose or total daily dose into two or more doses.

Specific delivery: As used herein, the term "specific delivery," "specifically deliver," or "specifically delivering" means delivery of more (e.g., at least 1.5 fold more, at least 2-fold more, at least 3-fold more, at least 4-fold more, at least 5-fold more, at least 6-fold more, at least 7-fold more, at least 8-fold more, at least 9-fold more, at least 10-fold more) of a polynucleotide by a nanoparticle to a target tissue of interest (e.g., mammalian liver) compared to an off-target tissue (e.g., mammalian spleen). The level of delivery of a nanoparticle to a particular tissue can be measured by comparing the amount of protein produced in a tissue to the weight of said tissue, comparing the amount of polynucleotide in a tissue to the weight of said tissue, comparing the amount of protein produced in a tissue to the amount of total protein in said tissue, or comparing the amount of polynucleotide in a tissue to the amount of total polynucleotide in said tissue. For example, for renovascular targeting, a polynucleotide is specifically provided to a mammalian kidney as compared to the liver and spleen if 1.5, 2-fold, 3-fold, 5-fold, 10-fold, 15 fold, or 20 fold more polynucleotide per 1 g of tissue is delivered to a kidney compared to that delivered to the liver or spleen following systemic administration of the polynucleotide. It will be understood that the ability of a nanoparticle to specifically deliver to a target tissue need not be determined in a subject being treated, it can be determined in a surrogate such as an animal model (e.g., a rat model).

Stable: As used herein "stable" refers to a compound that is sufficiently robust to survive isolation to a useful degree of purity from a reaction mixture, and in some cases capable of formulation into an efficacious therapeutic agent.

Stabilized: As used herein, the term "stabilize," "stabilized," "stabilized region" means to make or become stable.

Stereoisomer: As used herein, the term "stereoisomer" refers to all possible different isomeric as well as conformational forms that a compound can possess (e.g., a compound of any formula described herein), in particular all possible stereochemically and conformationally isomeric forms, all diastereomers, enantiomers and/or conformers of the basic molecular structure. Some compounds of the present disclosure can exist in different tautomeric forms, all of the latter being included within the scope of the present disclosure.

Subject: By "subject" or "individual" or "animal" or "patient" or "mammal," is meant any subject, particularly a mammalian subject, for whom diagnosis, prognosis, or therapy is desired. Mammalian subjects include, but are not limited to, humans, domestic animals, farm animals, zoo animals, sport animals, pet animals such as dogs, cats, guinea pigs, rabbits, rats, mice, horses, cattle, cows; primates such as apes, monkeys, orangutans, and chimpanzees; canids such as dogs and wolves; felids such as cats, lions, and tigers; equids such as horses, donkeys, and zebras; bears, food animals such as cows, pigs, and sheep; ungulates such as deer and giraffes; rodents such as mice, rats, hamsters and guinea pigs; and so on. In certain embodiments, the mammal is a human subject. In other embodiments, a subject is a human patient. In a particular embodiment, a subject is a human patient in need of treatment.

Substantially: As used herein, the term "substantially" refers to the qualitative condition of exhibiting total or near-total extent or degree of a characteristic or property of interest. One of ordinary skill in the biological arts will understand that biological and chemical characteristics rarely, if ever, go to completion and/or proceed to completeness or achieve or avoid an absolute result. The term "substantially" is therefore used herein to capture the potential lack of completeness inherent in many biological and chemical characteristics.

Substantially equal: As used herein as it relates to time differences between doses, the term means plus/minus 2%.

Substantially simultaneous: As used herein and as it relates to plurality of doses, the term means within 2 seconds.

Suffering from: An individual who is "suffering from" a disease, disorder, and/or condition has been diagnosed with or displays one or more signs and symptoms of the disease, disorder, and/or condition.

Susceptible to: An individual who is "susceptible to" a disease, disorder, and/or condition has not been diagnosed with and/or can not exhibit signs and symptoms of the disease, disorder, and/or condition but harbors a propensity to develop a disease or its signs and symptoms. In some embodiments, an individual who is susceptible to a disease, disorder, and/or condition (for example, cancer) can be characterized by one or more of the following: (1) a genetic mutation associated with development of the disease, disorder, and/or condition; (2) a genetic polymorphism associated with development of the disease, disorder, and/or condition; (3) increased and/or decreased expression and/or activity of a protein and/or nucleic acid associated with the disease, disorder, and/or condition; (4) habits and/or lifestyles associated with development of the disease, disorder, and/or condition; (5) a family history of the disease, disorder, and/or condition; and (6) exposure to and/or infection with a microbe associated with development of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Sustained release: As used herein, the term "sustained release" refers to a pharmaceutical composition or compound release profile that conforms to a release rate over a specific period of time.

Synthetic: The term "synthetic" means produced, prepared, and/or manufactured by the hand of man. Synthesis of polynucleotides or other molecules of the present disclosure can be chemical or enzymatic.

Targeted Cells: As used herein, "targeted cells" refers to any one or more cells of interest. The cells can be found in vitro, in vivo, in situ or in the tissue or organ of an organism. The organism can be an animal, for example a mammal, a human, a subject or a patient.

Target tissue: As used herein "target tissue" refers to any one or more tissue types of interest in which the delivery of a polynucleotide would result in a desired biological and/or pharmacological effect. Examples of target tissues of interest include specific tissues, organs, and systems or groups thereof. In particular applications, a target tissue can be a kidney, a lung, a spleen, vascular endothelium in vessels (e.g., intra-coronary or intra-femoral), or tumor tissue. An "off-target tissue" refers to any one or more tissue types in which the expression of the encoded protein does not result in a desired biological and/or pharmacological effect. In particular applications, off-target tissues can include the liver and the spleen.

The presence of a therapeutic agent in an off-target issue can be the result of: (i) leakage of a polynucleotide from the administration site to peripheral tissue or distant off-target tissue (e.g., liver) via diffusion or through the bloodstream (e.g., a polynucleotide intended to express a polypeptide in a certain tissue would reach the liver and the polypeptide would be expressed in the liver); or (ii) leakage of an polypeptide after administration of a polynucleotide encoding such polypeptide to peripheral tissue or distant off-target tissue (e.g., liver) via diffusion or through the bloodstream (e.g., a polynucleotide would expressed a polypeptide in the target tissue, and the polypeptide would diffuse to peripheral tissue).

Targeting sequence: As used herein, the phrase "targeting sequence" refers to a sequence that can direct the transport or localization of a protein or polypeptide.

Terminus: As used herein the terms "termini" or "terminus," when referring to polypeptides, refers to an extremity of a peptide or polypeptide. Such extremity is not limited only to the first or final site of the peptide or polypeptide but can include additional amino acids in the terminal regions. The polypeptide based molecules of the present disclosure can be characterized as having both an N-terminus (terminated by an amino acid with a free amino group ($NH_2$)) and a C-terminus (terminated by an amino acid with a free carboxyl group (COOH)). Proteins of the present disclosure are in some cases made up of multiple polypeptide chains brought together by disulfide bonds or by non-covalent forces (multimers, oligomers). These sorts of proteins will have multiple N- and C-termini. Alternatively, the termini of the polypeptides can be modified such that they begin or end, as the case can be, with a non-polypeptide based moiety such as an organic conjugate.

Therapeutic Agent: The term "therapeutic agent" refers to an agent that, when administered to a subject, has a therapeutic, diagnostic, and/or prophylactic effect and/or elicits a desired biological and/or pharmacological effect. For example, in some embodiments, an mRNA encoding a CFTR polypeptide can be a therapeutic agent.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve signs and symptoms of, diagnose, prevent, and/or delay the onset of the infection, disease, disorder, and/or condition.

Therapeutically effective outcome: As used herein, the term "therapeutically effective outcome" means an outcome that is sufficient in a subject suffering from or susceptible to an infection, disease, disorder, and/or condition, to treat, improve signs and symptoms of, diagnose, prevent, and/or delay the onset of the infection, disease, disorder, and/or condition.

Total daily dose: As used herein, a "total daily dose" is an amount given or prescribed in 24 hr. period. The total daily dose can be administered as a single unit dose or a split dose.

Transcription factor: As used herein, the term "transcription factor" refers to a DNA-binding protein that regulates transcription of DNA into RNA, for example, by activation or repression of transcription. Some transcription factors effect regulation of transcription alone, while others act in concert with other proteins. Some transcription factor can both activate and repress transcription under certain conditions. In general, transcription factors bind a specific target sequence or sequences highly similar to a specific consensus sequence in a regulatory region of a target gene. Transcription factors can regulate transcription of a target gene alone or in a complex with other molecules.

Transcription: As used herein, the term "transcription" refers to methods to produce mRNA (e.g., an mRNA sequence or template) from DNA (e.g., a DNA template or sequence).

Transfection: As used herein, "transfection" refers to the introduction of a polynucleotide (e.g., exogenous nucleic acids) into a cell wherein a polypeptide encoded by the polynucleotide is expressed (e.g., mRNA) or the polypeptide modulates a cellular function (e.g., siRNA, miRNA). As used herein, "expression" of a nucleic acid sequence refers to translation of a polynucleotide (e.g., an mRNA) into a polypeptide or protein and/or post-translational modification of a polypeptide or protein. Methods of transfection include, but are not limited to, chemical methods, physical treatments and cationic lipids or mixtures.

Treating, treatment, therapy: As used herein, the term "treating" or "treatment" or "therapy" refers to partially or completely alleviating, ameliorating, improving, relieving, delaying onset of, inhibiting progression of, reducing severity of, and/or reducing incidence of one or more signs and symptoms or features of a disease, e.g., cystic fibrosis. For example, "treating" cystic firbrosis can refer to diminishing signs and symptoms associated with the disease, prolong the lifespan (increase the survival rate) of patients, reducing the severity of the disease, preventing or delaying the onset of the disease, etc. Treatment can be administered to a subject who does not exhibit signs of a disease, disorder, and/or condition and/or to a subject who exhibits only early signs of a disease, disorder, and/or condition for the purpose of decreasing the risk of developing pathology associated with the disease, disorder, and/or condition.

Unmodified: As used herein, "unmodified" refers to any substance, compound or molecule prior to being changed in some way. Unmodified can, but does not always, refer to the wild type or native form of a biomolecule. Molecules can undergo a series of modifications whereby each modified molecule can serve as the "unmodified" starting molecule for a subsequent modification.

Uracil: Uracil is one of the four nucleobases in the nucleic acid of RNA, and it is represented by the letter U. Uracil can be attached to a ribose ring, or more specifically, a ribofuranose via a $\beta$-$N_1$-glycosidic bond to yield the nucleoside uridine. The nucleoside uridine is also commonly abbreviated according to the one letter code of its nucleobase, i.e., U. Thus, in the context of the present disclosure, when a monomer in a polynucleotide sequence is U, such U is designated interchangeably as a "uracil" or a "uridine."

Uridine Content: The terms "uridine content" or "uracil content" are interchangeable and refer to the amount of uracil or uridine present in a certain nucleic acid sequence. Uridine content or uracil content can be expressed as an absolute value (total number of uridine or uracil in the sequence) or relative (uridine or uracil percentage respect to the total number of nucleobases in the nucleic acid sequence).

Uridine Modified Sequence: The terms "uridine-modified sequence" refers to a sequence optimized nucleic acid (e.g., a synthetic mRNA sequence) with a different overall or local uridine content (higher or lower uridine content) or with different uridine patterns (e.g., gradient distribution or clustering) with respect to the uridine content and/or uridine patterns of a candidate nucleic acid sequence. In the content of the present disclosure, the terms "uridine-modified sequence" and "uracil-modified sequence" are considered equivalent and interchangeable.

A "high uridine codon" is defined as a codon comprising two or three uridines, a "low uridine codon" is defined as a codon comprising one uridine, and a "no uridine codon" is a codon without any uridines. In some embodiments, a uridine-modified sequence comprises substitutions of high uridine codons with low uridine codons, substitutions of high uridine codons with no uridine codons, substitutions of low uridine codons with high uridine codons, substitutions of low uridine codons with no uridine codons, substitution of no uridine codons with low uridine codons, substitutions of no uridine codons with high uridine codons, and combinations thereof. In some embodiments, a high uridine codon can be replaced with another high uridine codon. In some embodiments, a low uridine codon can be replaced with another low uridine codon. In some embodiments, a no uridine codon can be replaced with another no uridine codon. A uridine-modified sequence can be uridine enriched or uridine rarefied.

Uridine Enriched: As used herein, the terms "uridine enriched" and grammatical variants refer to the increase in uridine content (expressed in absolute value or as a percentage value) in an sequence optimized nucleic acid (e.g., a synthetic mRNA sequence) with respect to the uridine content of the corresponding candidate nucleic acid sequence. Uridine enrichment can be implemented by substituting codons in the candidate nucleic acid sequence with synonymous codons containing less uridine nucleobases. Uridine enrichment can be global (i.e., relative to the entire length of a candidate nucleic acid sequence) or local (i.e., relative to a subsequence or region of a candidate nucleic acid sequence).

Uridine Rarefied: As used herein, the terms "uridine rarefied" and grammatical variants refer to a decrease in uridine content (expressed in absolute value or as a percentage value) in an sequence optimized nucleic acid (e.g., a synthetic mRNA sequence) with respect to the uridine content of the corresponding candidate nucleic acid sequence. Uridine rarefication can be implemented by substituting codons in the candidate nucleic acid sequence with synonymous codons containing less uridine nucleobases. Uridine rarefication can be global (i.e., relative to the entire length of a candidate nucleic acid sequence) or local (i.e., relative to a subsequence or region of a candidate nucleic acid sequence).

Variant: The term variant as used in present disclosure refers to both natural variants (e.g., polymorphisms, isoforms, etc) and artificial variants in which at least one amino acid residue in a native or starting sequence (e.g., a wild type sequence) has been removed and a different amino acid inserted in its place at the same position. These variants can de described as "substitutional variants." The substitutions can be single, where only one amino acid in the molecule has been substituted, or they can be multiple, where two or more amino acids have been substituted in the same molecule. If amino acids are inserted or deleted, the resulting variant would be an "insertional variant" or a "deletional variant" respectively.

28. Equivalents and Scope

Those skilled in the art will recognize, or be able to ascertain using no more than routine experimentation, many equivalents to the specific embodiments in accordance with the present disclosure described herein. The scope of the present disclosure is not intended to be limited to the above Description, but rather is as set forth in the appended claims.

In the claims, articles such as "a," "an," and "the" can mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The present disclosure includes embodiments in which exactly one member of the group is present in, employed in, or otherwise relevant to a given product or process. The present disclosure includes embodiments in which more than one, or all of the group members are present in, employed in, or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the present disclosure, to the tenth of the unit of the lower limit of the range, unless the context clearly dictates otherwise.

In addition, it is to be understood that any particular embodiment of the present disclosure that falls within the prior art can be explicitly excluded from any one or more of the claims. Since such embodiments are deemed to be known to one of ordinary skill in the art, they can be excluded even if the exclusion is not set forth explicitly herein. Any particular embodiment of the compositions of the present disclosure (e.g., any nucleic acid or protein encoded thereby; any method of production; any method of use; etc.) can be excluded from any one or more claims, for any reason, whether or not related to the existence of prior art.

All cited sources, for example, references, publications, databases, database entries, and art cited herein, are incorporated into this application by reference, even if not expressly stated in the citation. In case of conflicting statements of a cited source and the instant application, the statement in the instant application shall control.

Section and table headings are not intended to be limiting.

EXAMPLES

Example 1

Chimeric Polynucleotide Synthesis

A. Triphosphate Route

Two regions or parts of a chimeric polynucleotide can be joined or ligated using triphosphate chemistry. According to this method, a first region or part of 100 nucleotides or less can be chemically synthesized with a 5' monophosphate and terminal 3'desOH or blocked OH. If the region is longer than 80 nucleotides, it can be synthesized as two strands for ligation.

If the first region or part is synthesized as a non-positionally modified region or part using in vitro transcription (IVT), conversion the 5'monophosphate with subsequent capping of the 3' terminus can follow. Monophosphate protecting groups can be selected from any of those known in the art.

The second region or part of the chimeric polynucleotide can be synthesized using either chemical synthesis or IVT methods. IVT methods can include an RNA polymerase that can utilize a primer with a modified cap. Alternatively, a cap of up to 80 nucleotides can be chemically synthesized and coupled to the IVT region or part.

It is noted that for ligation methods, ligation with DNA T4 ligase, followed by treatment with DNAse should readily avoid concatenation.

The entire chimeric polynucleotide need not be manufactured with a phosphate-sugar backbone. If one of the regions or parts encodes a polypeptide, then such region or part can comprise a phosphate-sugar backbone.

Ligation can then be performed using any known click chemistry, orthoclick chemistry, solulink, or other bioconjugate chemistries known to those in the art.

B. Synthetic Route

The chimeric polynucleotide can be made using a series of starting segments. Such segments include:
(a) Capped and protected 5' segment comprising a normal 3'OH (SEG. 1)
(b) 5' triphosphate segment which can include the coding region of a polypeptide and comprising a normal 3'OH (SEG. 2)
(c) 5' monophosphate segment for the 3' end of the chimeric polynucleotide (e.g., the tail) comprising cordycepin or no 3'OH (SEG. 3)

After synthesis (chemical or IVT), segment 3 (SEG. 3) can be treated with cordycepin and then with pyrophosphatase to create the 5'monophosphate.

Segment 2 (SEG. 2) can then be ligated to SEG. 3 using RNA ligase. The ligated polynucleotide can then be purified and treated with pyrophosphatase to cleave the diphosphate. The treated SEG.2-SEG. 3 construct is then purified and SEG. 1 is ligated to the 5' terminus. A further purification step of the chimeric polynucleotide can be performed.

Where the chimeric polynucleotide encodes a polypeptide, the ligated or joined segments can be represented as: 5'UTR (SEG. 1), open reading frame or ORF (SEG. 2) and 3'UTR+PolyA (SEG. 3).

The yields of each step can be as much as 90-95%.

Example 2

PCR for cDNA Production

PCR procedures for the preparation of cDNA can be performed using 2× KAPA HIFI™ HotStart ReadyMix by Kapa Biosystems (Woburn, MA). This system includes 2× KAPA ReadyMix12.5 µl; Forward Primer (10 µM) 0.75 µl; Reverse Primer (10 µM) 0.75 µl; Template cDNA-100 ng; and dH$_2$O diluted to 25.0 µl. The PCR reaction conditions can be: at 95° C. for 5 min. and 25 cycles of 98° C. for 20 sec, then 58° C. for 15 sec, then 72° C. for 45 sec, then 72° C. for 5 min. then 4° C. to termination.

The reverse primer of the instant disclosure can incorporate a poly-T$_{120}$ for a poly-A$_{120}$ in the mRNA. Other reverse primers with longer or shorter poly(T) tracts can be used to adjust the length of the poly(A) tail in the polynucleotide mRNA.

The reaction can be cleaned up using Invitrogen's PURELINK™ PCR Micro Kit (Carlsbad, CA) per manufacturer's instructions (up to 5 µg). Larger reactions will require a cleanup using a product with a larger capacity. Following the cleanup, the cDNA can be quantified using the NANODROP™ and analyzed by agarose gel electrophoresis to confirm the cDNA is the expected size. The cDNA can then be submitted for sequencing analysis before proceeding to the in vitro transcription reaction.

Example 3

In vitro Transcription (IVT)

The in vitro transcription reactions can generate polynucleotides containing uniformly modified polynucleotides. Such uniformly modified polynucleotides can comprise a region or part of the polynucleotides of the present disclosure. The input nucleotide triphosphate (NTP) mix can be made using natural and un-natural NTPs.

A typical in vitro transcription reaction can include the following:
1 Template cDNA—1.0 μg
2 10× transcription buffer (400 mM Tris-HCl pH 8.0, 190 mM $MgCl_2$, 50 mM DTT, 10 mM Spermidine)—2.0 μl
3 Custom NTPs (25 mM each)—7.2 μl
4 RNase Inhibitor—20 U
5 T7 RNA polymerase—3000 U
6 $dH_2O$—Up to 20.0 μl. and
7 Incubation at 37° C. for 3 hr-5 hrs.

The crude IVT mix can be stored at 4° C. overnight for cleanup the next day. 1 U of RNase-free DNase can then be used to digest the original template. After 15 minutes of incubation at 37° C., the mRNA can be purified using Ambion's MEGACLEAR™ Kit (Austin, TX) following the manufacturer's instructions. This kit can purify up to 500 μg of RNA. Following the cleanup, the RNA can be quantified using the NanoDrop and analyzed by agarose gel electrophoresis to confirm the RNA is the proper size and that no degradation of the RNA has occurred.

Example 4

Enzymatic Capping

Capping of a polynucleotide can be performed with a mixture includes: IVT RNA 60 μg-180 μg and $dH_2O$ up to 72 μl. The mixture can be incubated at 65° C. for 5 minutes to denature RNA, and then can be transferred immediately to ice.

The protocol can then involve the mixing of 10× Capping Buffer (0.5 M Tris-HCl (pH 8.0), 60 mM KCl, 12.5 mM $MgCl_2$) (10.0 μl); 20 mM GTP (5.0 μl); 20 mM S-Adenosyl Methionine (2.5 μl); RNase Inhibitor (100 U); 2'-O-Methyltransferase (400U); Vaccinia capping enzyme (Guanylyl transferase) (40 U); $dH_2O$ (Up to 28 μl); and incubation at 37° C. for 30 minutes for 60 μg RNA or up to 2 hours for 180 μg of RNA.

The polynucleotide can then be purified using Ambion's MEGACLEAR™ Kit (Austin, TX) following the manufacturer's instructions. Following the cleanup, the RNA can be quantified using the NANODROP™ (ThermoFisher, Waltham, MA) and analyzed by agarose gel electrophoresis to confirm the RNA is the proper size and that no degradation of the RNA has occurred. The RNA product can also be sequenced by running a reverse-transcription-PCR to generate the cDNA for sequencing.

Example 5

PolyA Tailing Reaction

Without a poly-T in the cDNA, a poly-A tailing reaction must be performed before cleaning the final product. This can be done by mixing Capped IVT RNA (100 μl); RNase Inhibitor (20 U); 10× Tailing Buffer (0.5 M Tris-HCl (pH 8.0), 2.5 M NaCl, 100 mM $MgCl_2$)(12.0 μl); 20 mM ATP (6.0 μl); Poly-A Polymerase (20 U); $dH_2O$ up to 123.5 μl and incubating at 37° C. for 30 min. If the poly-A tail is already in the transcript, then the tailing reaction can be skipped and proceed directly to cleanup with Ambion's MEGA-CLEAR™ kit (Austin, TX) (up to 500 μg). Poly-A Polymerase is, in some cases, a recombinant enzyme expressed in yeast.

It should be understood that the processivity or integrity of the polyA tailing reaction does not always result in an exact size polyA tail. Hence polyA tails of approximately between 40-200 nucleotides, e.g., about 40, 50, 60, 70, 80, 90, 91, 92, 93, 94, 95, 96, 97, 98, 99, 100, 101, 102, 103, 104, 105, 106, 107, 108, 109, 110, 150-165, 155, 156, 157, 158, 159, 160, 161, 162, 163, 164 or 165 are within the scope of the present disclosure.

Example 6

Natural 5' Caps and 5' Cap Analogues

5'-capping of polynucleotides can be completed concomitantly during the in vitro-transcription reaction using the following chemical RNA cap analogs to generate the 5'-guanosine cap structure according to manufacturer protocols: 3'-O-Me-m7G(5')ppp(5') G [the ARCA cap];G(5')ppp(5')A; G(5')ppp(5')G; m7G(5')ppp(5')A; m7G(5')ppp(5')G (New England BioLabs, Ipswich, MA). 5'-capping of modified RNA can be completed post-transcriptionally using a Vaccinia Virus Capping Enzyme to generate the "Cap 0" structure: m7G(5')ppp(5')G (New England BioLabs, Ipswich, Mas.). Cap 1 structure can be generated using both Vaccinia Virus Capping Enzyme and a 2'-O methyltransferase to generate: m7G(5')ppp(5')G-2'-O-methyl. Cap 2 structure can be generated from the Cap 1 structure followed by the 2'-O-methylation of the 5'-antepenultimate nucleotide using a 2'-O methyl-transferase. Cap 3 structure can be generated from the Cap 2 structure followed by the 2'-O-methylation of the 5'-preantepenultimate nucleotide using a 2'-O methyl-transferase. Enzymes can be derived from a recombinant source.

When transfected into mammalian cells, the modified mRNAs can have a stability of between 12-18 hours or more than 18 hours, e.g., 24, 36, 48, 60, 72 or greater than 72 hours.

Example 7

Capping Assays

A. Protein Expression Assay

Polynucleotides encoding a polypeptide, containing any of the caps taught herein, can be transfected into cells at equal concentrations. After 6, 12, 24 and 36 hours post-transfection, the amount of protein secreted into the culture medium can be assayed by ELISA. Synthetic polynucleotides that secrete higher levels of protein into the medium would correspond to a synthetic polynucleotide with a higher translationally-competent Cap structure.

B. Purity Analysis Synthesis

Polynucleotides encoding a polypeptide, containing any of the caps taught herein, can be compared for purity using denaturing Agarose-Urea gel electrophoresis or HPLC analysis. Polynucleotides with a single, consolidated band by electrophoresis correspond to the higher purity product compared to polynucleotides with multiple bands or streaking bands. Synthetic polynucleotides with a single HPLC peak would also correspond to a higher purity product. The capping reaction with a higher efficiency would provide a more pure polynucleotide population.

C. Cytokine Analysis

Polynucleotides encoding a polypeptide, containing any of the caps taught herein, can be transfected into cells at multiple concentrations. After 6, 12, 24 and 36 hours post-transfection the amount of pro-inflammatory cytokines such as TNF-alpha and IFN-beta secreted into the culture medium can be assayed by ELISA. Polynucleotides resulting in the secretion of higher levels of pro-inflammatory cytokines into the medium would correspond to polynucleotides containing an immune-activating cap structure.

D. Capping Reaction Efficiency

Polynucleotides encoding a polypeptide, containing any of the caps taught herein, can be analyzed for capping reaction efficiency by LC-MS after nuclease treatment. Nuclease treatment of capped polynucleotides would yield a mixture of free nucleotides and the capped 5'-5-triphosphate cap structure detectable by LC-MS. The amount of capped product on the LC-MS spectra can be expressed as a percent of total polynucleotide from the reaction and would correspond to capping reaction efficiency. The cap structure with higher capping reaction efficiency would have a higher amount of capped product by LC-MS.

Example 8

Agarose Gel Electrophoresis of Modified RNA or RT PCR Products

Individual polynucleotides (200-400 ng in a 20 μl volume) or reverse transcribed PCR products (200-400 ng) can be loaded into a well on a non-denaturing 1.2% Agarose E-Gel (Invitrogen, Carlsbad, CA) and run for 12-15 minutes according to the manufacturer protocol.

Example 9

Nanodrop Modified RNA Quantification and UV Spectral Data

Modified polynucleotides in TE buffer (1 μl) can be used for Nanodrop UV absorbance readings to quantitate the yield of each polynucleotide from an chemical synthesis or in vitro transcription reaction.

Example 10

Formulation of Modified mRNA Using Lipidoids

Polynucleotides can be formulated for in vitro experiments by mixing the polynucleotides with the lipidoid at a set ratio prior to addition to cells. In vivo formulation can require the addition of extra ingredients to facilitate circulation throughout the body. To test the ability of these lipidoids to form particles suitable for in vivo work, a standard formulation process used for siRNA-lipidoid formulations can be used as a starting point. After formation of the particle, polynucleotide can be added and allowed to integrate with the complex. The encapsulation efficiency can be determined using a standard dye exclusion assays.

Example 11

Method of Screening for Protein Expression

A. Electrospray Ionization

A biological sample that can contain proteins encoded by a polynucleotide administered to the subject can be prepared and analyzed according to the manufacturer protocol for electrospray ionization (ESI) using 1, 2, 3 or 4 mass analyzers. A biologic sample can also be analyzed using a tandem ESI mass spectrometry system.

Patterns of protein fragments, or whole proteins, can be compared to known controls for a given protein and identity can be determined by comparison.

B. Matrix-Assisted Laser Desorption/Ionization

A biological sample that can contain proteins encoded by one or more polynucleotides administered to the subject can be prepared and analyzed according to the manufacturer protocol for matrix-assisted laser desorption/ionization (MALDI).

Patterns of protein fragments, or whole proteins, can be compared to known controls for a given protein and identity can be determined by comparison.

C. Liquid Chromatography-Mass Spectrometry-Mass Spectrometry

A biological sample, which can contain proteins encoded by one or more polynucleotides, can be treated with a trypsin enzyme to digest the proteins contained within. The resulting peptides can be analyzed by liquid chromatography-mass spectrometry-mass spectrometry (LC/MS/MS). The peptides can be fragmented in the mass spectrometer to yield diagnostic patterns that can be matched to protein sequence databases via computer algorithms. The digested sample can be diluted to achieve 1 ng or less starting material for a given protein. Biological samples containing a simple buffer background (e.g., water or volatile salts) are amenable to direct in-solution digest; more complex backgrounds (e.g., detergent, non-volatile salts, glycerol) require an additional clean-up step to facilitate the sample analysis.

Patterns of protein fragments, or whole proteins, can be compared to known controls for a given protein and identity can be determined by comparison.

Example 12

Synthesis of mRNA Encoding CFTR

Sequence optimized polynucleotides encoding CFTR polypeptides, i.e., SEQ ID NO: 1, or 3 are synthesized and characterized as described in Examples 1 to 11. mRNA's encoding both human CFTR are prepared for Examples 13-19 described below, and are synthesized and characterized as described in Examples 1 to 11.

An mRNA encoding human CFTR is constructed, e.g., by using the ORF sequence provided in SEQ ID NO: 2. The mRNA sequence includes both 5' and 3' UTR regions (see, e.g., SEQ ID NOs: 103 and 104, respectively). In a construct, the 5'UTR and 3'UTR sequences are:

5'UTR
(SEQ ID NO: 103)
TCAAGCTTTTGGACCCTCGTACAGAAGCTAATACGACTCACTATAGGGAAA

TAAGAGAGAAAAGAAGAGTAAGAAGAAATATAAGAGCCACC

3'UTR
(SEQ ID NO: 104)
TGATAATAGGCTGGAGCCTCGGTGGCCATGCTTCTTGCCCCTTGGGCCTCC

CCCCAGCCCCTCCTCCCCTTCCTGCACCCGTACCCCCGTGGTCTTTGAATA

AAGTCTGAGTGGGCGGC

The CFTR mRNA sequence is prepared as modified mRNA. Specifically, during in vitro translation, modified mRNA is generated using 5-methoxy-UTP to ensure that the mRNAs contain 100% 5-methoxy-uridine instead of uridine. Further, CFTR-mRNA is synthesized with a primer that introduces a polyA-tail, and a Cap 1 structure is generated on both mRNAs using Vaccinia Virus Capping Enzyme and a 2'-O methyl-transferase to generate: m7G(5')ppp(5')G-2'-O-methyl.

Example 13

Detecting Endogenous CFTR Expression In Vitro

CFTR expression is characterized in a variety of cell lines derived from both mice and human sources. Cell are cultured in standard conditions and cell extracts are obtained by placing the cells in lysis buffer. For comparison purposes, appropriate controls are also prepared. To analyze CFTR expression, lysate samples are prepared from the tested cells and mixed with lithium dodecyl sulfate sample loading buffer and subjected to standard Western blot analysis. For detection of CFTR, the antibody used is a commercial anti-CFTR antibody. For detection of a load control, the antibody used is anti-citrase synthase (rabbit polyclonal; PAS-22126; Thermo-Fisher Scientific®). To examine the localization of endogenous CFTR, immunofluorescence analysis is performed on cells. CFTR expression is detected using a commercial anti-CFTR. The location of specific organelles can be detected with existing commercial products. For example, mitochondria can be detected using Mitotracker, and the nucleus can be stained with DAPI. Image analysis is performed on a Zeiss ELYRA imaging system.

Endogenous CFTR expression can be used as a base line to determine changes in CFTR expression resulting from transfection with mRNAs comprising nucleic acids encoding CFTR.

Example 14

In Vitro Expression of CFTR in HeLa Cells

To measure in vitro expression of human CFTR in HeLa cells, those cells are seeded on 12-well plates (BD Biosciences, San Jose, USA) one day prior to transfection. mRNA formulations comprising human CFTR or a GFP control are transfected using 800 ng mRNA and 2 µL Lipofectamin 2000 in 60 µL OPTI-MEM per well and incubated.

After 24 hours, the cells in each well are lysed using a consistent amount of lysis buffer. Appropriate controls are used. Protein concentrations of each are determined using a BCA assay according to manufacturer's instructions. To analyze CFTR expression, equal loads of each lysate (24 µg) are prepared in a loading buffer and subjected to standard Western blot analysis. For detection of CFTR, a commercial anti-CFTR antibody is used according to the manufacturer's instructions.

Example 15

In Vitro CFTR Activity in HeLa Cells

An in vitro CFTR activity assay is performed to determine whether CFTR exogenously-expressed after introduction of mRNA comprising a CFTR sequence is active.
A. Expression Assay HeLa cells are transfected with mRNA formulations comprising human CFTR or a GFP control. Cells are transfected with Lipofectamin 2000 and lysed as described in Example 14 above. Appropriate controls are also prepared.
B. Activity Assay To assess whether exogenous CFTR can function, an in vitro activity assay is performed using transfected HeLa cell lysates as the source of enzymatic activity. To begin, lysate is mixed CFTR substrate. The reaction is stopped by adding 100 g/L TCA and vortexing. The reaction tubes are then centrifuged at 13,000 g for 1 min, and the supernatant is analyzed for the presence of labeled enzymatic products resulting from the activity of CFTR using HPLC-based separation and quantification. Specifically, 20 µL of each activity reaction supernatant are analyzed using a HPLC system equipped with a Quaternary-Pump, a Multi-sampler, a Thermostated Column-Compartment, a Poroshell EC-C18 120 HPLC-column and a Radiometric Detector controlled by OpenLAB Chromatography Data System, all used according to the manufacturers' recommendations.

Example 16

Measuring In Vitro Expression of CFTR in Cells

Cells from normal subjects and cystic fibrosis patients are examined for their capacity to express exogenous CFTR. Cells are transfected with mRNA formulations comprising human CFTR, mouse CFTR, or a GFP control via electroporation using a standard protocol. Each construct is tested separately. After incubation, cells are lysed and protein concentration in each lysate is measured using a suitable assay, e.g., by BCA assay. To analyze CFTR expression, equal loads of each lysate are prepared in a loading buffer and subjected to standard Western blot analysis. For detection of CFTR, an anti-CFTR is used. For detection of a load control, the antibody used is anti-citrase synthase (rabbit polyclonal; MA5-17625; Pierce®).

Example 17

Measuring In Vitro CFTR Activity in Lysates

A. Expression

Cells from normal human subjects and cystic fibrosis patients are cultured. Cells are transfected with mRNA formulations comprising human CFTR, mouse CFTR, or a GFP control via electroporation using a standard protocol.
B. Activity Assay To assess whether exogenous CFTR function, an in vitro activity assay is performed using transfected cell lysates as the source of enzymatic activity. Lysate containing expressed CFTR protein is incubated with labeled CFTR substrate, and the activity of CFTR is quantified by measuring the levels of labeled products resulting from the enzymatic activity of CFTR.

Example 18

In Vivo CFTR Expression in Animal Models

To assess the ability of CFTR-containing mRNA's to facilitate CFTR expression in vivo, mRNA encoding human CFTR is introduced into C57B/L6 mice. C57B/L6 mice are injected intravenously with either control mRNA (NT-FIX) or human CFTR mRNA. The mRNA is formulated in lipid nanoparticles for delivery into the mice. Mice are sacrificed after 24 or 48 hrs. and CFTR protein levels in liver lysates are determined by capillary electrophoresis (CE). Citrate synthase expression is examined for use as a load control. For control NT-FIX injections, 4 mice are tested for each time point. For human CFTR mRNA injections, 6 mice are tested for each time point. Treatment with mRNA encoding CFTR is expected to reliably induce expression of CFTR.

Example 19

Human CFTR Mutant and Chimeric Constructs

A polynucleotide of the present disclosure can comprise at least a first region of linked nucleosides encoding human CFTR, which can be constructed, expressed, and characterized according to the examples above. Similarly, the polynucleotide sequence can contain one or more mutations that results in the expression of a CFTR with increased or decreased activity. Furthermore, the polynucleotide sequence encoding CFTR can be part of a construct encoding a chimeric fusion protein.

Example 20

Synthesis of Compounds According to Formula (I)

A. General Considerations

All solvents and reagents used were obtained commercially and used as such unless noted otherwise. $^1$H NMR spectra were recorded in $CDCl_3$, at 300 K using a Bruker Ultrashield 300 MHz instrument. Chemical shifts are reported as parts per million (ppm) relative to TMS (0.00) for $^1$H. Silica gel chromatographies were performed on ISCO CombiFlash Rf+ Lumen Instruments using ISCO RediSep Rf Gold Flash Cartridges (particle size: 20-40 microns). Reverse phase chromatographies were performed on ISCO CombiFlash Rf+ Lumen Instruments using RediSep Rf Gold C18 High Performance columns. All final compounds were determined to be greater than 85% pure via analysis by reverse phase UPLC-MS (retention times, RT, in minutes) using Waters Acquity UPLC instrument with DAD and ELSD and a ZORBAX Rapid Resolution High Definition (RRHD) SB—C18 LC column, 2.1 mm, 50 mm, 1.8 µm, and a gradient of 65 to 100% acetonitrile in water with 0.1% TFA over 5 minutes at 1.2 mL/min. Injection volume was 54 and the column temperature was 80° C. Detection was based on electrospray ionization (ESI) in positive mode using Waters SQD mass spectrometer (Milford, MA, USA) and evaporative light scattering detector.

The representative procedures described below are useful in the synthesis of Compounds 1-147.

The following abbreviations are employed herein:
THF: Tetrahydrofuran
DMAP: 4-Dimethylaminopyridine
LDA: Lithium Diisopropylamide
rt: Room Temperature
DME: 1,2-Dimethoxyethane
n-BuLi: n-Butyllithium B. Compound 2: Heptadecan-9-yl 8-((2-hydroxyethyl)(tetradecyl)amino) octanoate Representative Procedure 1:

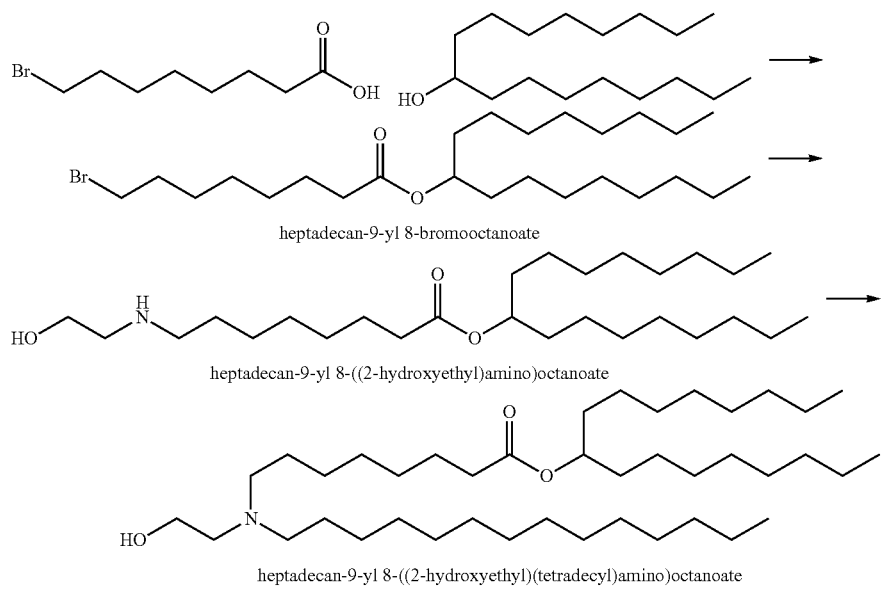

Heptadecan-9-yl 8-bromooctanoate (Method A)

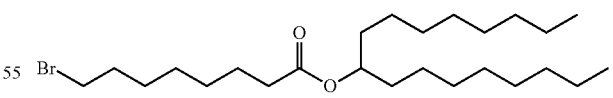

To a solution of 8-bromooctanoic acid (1.04 g, 4.6 mmol) and heptadecan-9-ol (1.5 g, 5.8 mmol) in dichloromethane (20 mL) was added N-(3-dimethylaminopropyl)-N'-ethylcarbodiimide hydrochloride (1.1 g, 5.8 mmol), N,N-diisopropylethylamine (3.3 mL, 18.7 mmol) and DMAP (114 mg, 0.9 mmol). The reaction was allowed to stir at rt for 18 h. The reaction was diluted with dichloromethane and washed with saturated sodium bicarbonate. The organic layer was separated and washed with brine, and dried over $MgSO_4$. The organic layer was filtered and evaporated in vacuo. The residue was purified by silica gel chromatography (0-10% ethyl acetate in hexanes) to obtain heptadecan-9-yl 8-bromooctanoate (875 mg, 1.9 mmol, 41%).

$^1$H NMR (300 MHz, CDCl$_3$) δ: ppm 4.89 (m, 1H); 3.42 (m, 2H); 2.31 (m, 2H); 1.89 (m, 2H); 1.73-1.18 (br. m, 36H); 0.88 (m, 6H).

Heptadecan-9-yl 8-((2-hydroxyethyl)amino)octanoate (Method B)

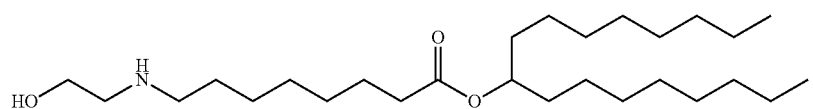 [SMILES: CCCCCCCCC(CCCCCCCC)OC(=O)CCCCCCCNCCO]

A solution of heptadecan-9-yl 8-bromooctanoate (3.8 g, 8.2 mmol) and 2-aminoethan-1-ol (15 mL, 248 mmol) in ethanol (3 mL) was allowed to stir at 62° C. for 18 h. The reaction mixture was concentrated in vacuo and the residue was taken-up in ethyl acetate and water. The organic layer was separated and washed with water, brine and dried over Na$_2$SO$_4$. The mixture was filtered and evaporated in vacuo. The residue was purified by silica gel chromatography (0-100% (mixture of 1% NH$_4$OH, 20% MeOH in dichloromethane) in dichloromethane) to obtain heptadecan-9-yl 8-((2-hydroxyethyl)amino)octanoate (3.1 g, 7 mmol, 85%). UPLC/ELSD: RT=2.67 min. MS (ES): m/z (MH') 442.68 for C$_{27}$H$_{55}$NO$_3$ $^1$H NMR (300 MHz, CDCl$_3$) δ: ppm 4.89 (p, 1H); 3.67 (t, 2H); 2.81 (t, 2H); 2.65 (t, 2H); 2.30 (t, 2H); 2.05 (br. m, 2H); 1.72-1.41 (br. m, 8H); 1.40-1.20 (br. m, 30H); 0.88 (m, 6H).

Heptadecan-9-yl 8-((2-hydroxyethyl)(tetradecyl)amino)octanoate (Method C)

A solution of heptadecan-9-yl 8-((2-hydroxyethyl)amino) octanoate (125 mg, 0.28 mmol), 1-bromotetradecane (94 mg, 0.34 mmol) and N,N-diisopropylethylamine (44 mg, 0.34 mmol) in ethanol was allowed to stir at 65° C. for 18 h. The reaction was cooled to rt and solvents were evaporated in vacuo. The residue was taken-up in ethyl acetate and saturated sodium bicarbonate. The organic layer was separated, dried over Na$_2$SO$_4$ and evaporated in vacuo. The residue was purified by silica gel chromatography (0-100% (mixture of 1% NH$_4$OH, 20% MeOH in dichloromethane) in dichloromethane) to obtain heptadecan-9-yl 8-((2-hydroxyethyl)(tetradecyl)amino)octanoate (89 mg, 0.14 mmol, 50%). UPLC/ELSD: RT=3.61 min. MS (ES): m/z (MH$^+$) 638.91 for C$_{41}$H$_{83}$NO$_3$. $^1$H NMR (300 MHz, CDCl$_3$) δ: ppm 4.86 (p, 1H); 3.72-3.47 (br. m, 2H); 2.78-2.40 (br. m, 5H); 2.28 (t, 2H); 1.70-1.40 (m, 10H); 1.38-1.17 (br. m, 54H); 0.88 (m, 9H).

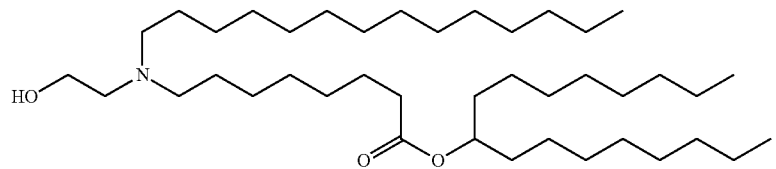

Chemical Formula: C$_{41}$H$_{83}$NO$_3$
Molecular Weight: 638.12

Synthesis of Intermediates:

Intermediate A: 2-Octyldecanoic Acid

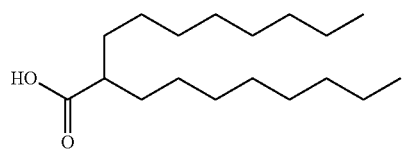 [SMILES: CCCCCCCCC(CCCCCCCC)C(=O)O]

A solution of diisopropylamine (2.92 mL, 20.8 mmol) in THF (10 mL) was cooled to −78° C. and a solution of n-BuLi (7.5 mL, 18.9 mmol, 2.5 M in hexanes) was added. The reaction was allowed to warm to 0° C. To a solution of decanoic acid (2.96 g, 17.2 mmol) and NaH (754 mg, 18.9 mmol, 60% w/w) in THF (20 mL) at 0° C. was added the solution of LDA and the mixture was allowed to stir at rt for 30 min. After this time 1-iodooctane (5 g, 20.8 mmol) was added and the reaction mixture was heated at 45° C. for 6 h. The reaction was quenched with 1N HCl (10 mL). The organic layer was dried over MgSO$_4$, filtered and evaporated in vacuo. The residue was purified by silica gel chromatography (0-20% ethyl acetate in hexanes) to yield 2-octyldecanoic acid (1.9 g, 6.6 mmol, 38%). $^1$H NMR (300 MHz, CDCl$_3$) δ: ppm 2.38 (br. m, 1H); 1.74-1.03 (br. m, 28H); 0.91 (m, 6H).

Intermediate B: 7-Bromoheptyl 2-octyldecanoate

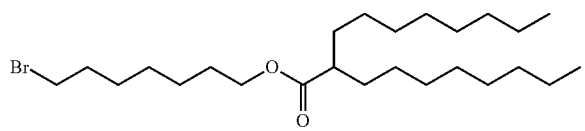 [SMILES: CCCCCCCCC(CCCCCCCC)C(=O)OCCCCCCCBr]

7-bromoheptyl 2-octyldecanoate was synthesized using Method A from 2-octyldecanoic acid and 7-bromoheptan-1-ol. $^1$H NMR (300 MHz, CDCl$_3$) δ: ppm 4.09 (br. m, 2H); 3.43 (br. m, 2H); 2.48-2.25 (br. m, 1H); 1.89 (br. m, 2H); 1.74-1.16 (br. m, 36H); 0.90 (m, 6H).

Intermediate C: (2-Hexylcyclopropyl)methanol

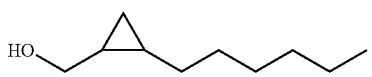

A solution of diethyl zinc (20 mL, 20 mmol, 1 M in hexanes), in dichloromethane (20 mL) was allowed to cool to −40° C. for 5 min. Then a solution of diiodomethane (3.22 mL, 40 mmol) in dichloromethane (10 mL) was added dropwise. After the reaction was allowed to stir for 1 h at −40° C., a solution of trichloro-acetic acid (327 mg, 2 mmol) and DME (1 mL, 9.6 mmol) in dichloromethane (10 mL) was added. The reaction was allowed to warm to −15° C. and stir at this temperature for 1 h. A solution of (Z)-non-2-en-1-ol (1.42 g, 10 mmol) in dichloromethane (10 mL) was then added to the −15° C. solution. The reaction was then slowly allowed to warm to rt and stir for 18 h. After this time saturated NH$_4$C$_1$ (200 mL) was added and the reaction was extracted with dichloromethane (3×), washed with brine, and dried over Na$_2$SO$_4$. The organic layer was filtered, evaporated in vacuo and the residue was purified by silica gel chromatography (0-50% ethyl acetate in hexanes) to yield (2-hexylcyclopropyl)methanol (1.43 g, 9.2 mmol, 92%). $^1$H NMR (300 MHz, CDCl$_3$) δ: ppm 3.64 (m, 2H); 1.57-1.02 (m, 12H); 0.99-0.80 (m, 4H); 0.72 (m, 1H), 0.00 (m, 1H).

C. Compound 18: Heptadecan-9-yl 8-((2-hydroxyethyl)(8-(nonyloxy)-8-oxooctyl)amino) octanoate Compound 18 was synthesized according to the general procedure and Representative Procedure 1 described above.

UPLC/ELSD: RT=3.59 min. MS (ES): m/z (MH$^+$) 710.89 for C$_{44}$H$_{87}$NO$_5$. $^1$H NMR (300 MHz, CDCl$_3$) δ: ppm 4.86 (m, 1H); 4.05 (t, 2H); 3.53 (br. m, 2H); 2.83-2.36 (br. m, 5H); 2.29 (m, 4H); 0.96-1.71 (m, 64H); 0.88 (m, 9H).

D. Compound 136: Nonyl 8-((2-hydroxyethyl)((9Z,12Z)-octadeca-9,12-dien-1-yl)amino)octanoate Representative Procedure 2:

Nonyl 8-bromooctanoate (Method A)

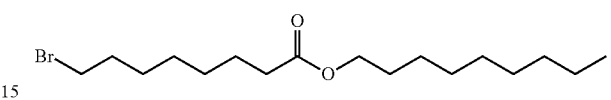

To a solution of 8-bromooctanoic acid (5 g, 22 mmol) and nonan-1-ol (6.46 g, 45 mmol) in dichloromethane (100 mL) were added N-(3-Dimethylaminopropyl)-N'-ethylcarbodiimide hydrochloride (4.3 g, 22 mmol) and DMAP (547 mg, 4.5 mmol). The reaction was allowed to stir at rt for 18 h. The reaction was diluted with dichloromethane and washed with saturated sodium bicarbonate. The organic layer was separated and washed with brine, dried over MgSO$_4$. The organic layer was filtered and evaporated under vacuum. The residue was purified by silica gel chromatography (0-10% ethyl acetate in hexanes) to obtain nonyl 8-bromooctanoate (6.1 g, 17 mmol, 77%).

$^1$H NMR (300 MHz, CDCl$_3$) δ: ppm 4.06 (t, 2H); 3.40 (t, 2H); 2.29 (t, 2H); 1.85 (m, 2H); 1.72-0.97 (m, 22H); 0.88 (m, 3H).

Nonyl 8-((2-hydroxyethyl)amino)octanoate

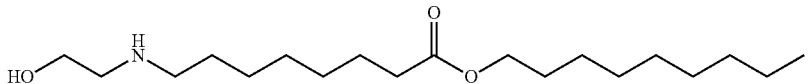 [SMILES: CCCCCCCCCOC(=O)CCCCCCCNCCO]

A solution of nonyl 8-bromooctanoate (1.2 g, 3.4 mmol) and 2-aminoethan-1-ol (5 mL, 83 mmol) in ethanol (2 mL) was allowed to stir at 62° C. for 18 h. The reaction mixture was concentrated in vacuum and the residue was extracted with ethyl acetate and water. The organic layer was separated and washed with water, brine and dried over Na$_2$SO$_4$. The organic layer was filtered and evaporated in vacuo. The residue was purified by silica gel chromatography (0-100% (mixture of 1% NH$_4$OH, 20% MeOH in dichloromethane) in dichloromethane) to obtain nonyl 8-((2-hydroxyethyl)amino)octanoate (295 mg, 0.9 mmol, 26%).

UPLC/ELSD: RT=1.29 min. MS (ES): m/z (MH$^+$) 330.42 for C$_{19}$H$_{39}$NO$_3$

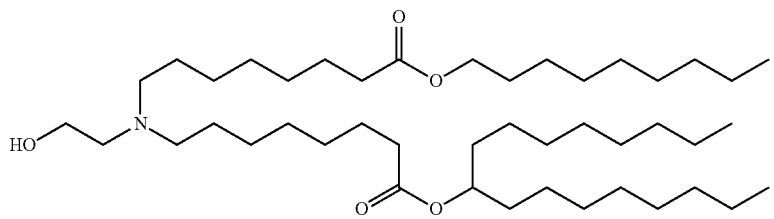

Chemical Formula: C$_{44}$H$_{87}$NO$_5$
Molecular Weight: 710.18

$^1$H NMR (300 MHz, CDCl$_3$) δ: ppm 4.07 (t, 2H); 3.65 (t, 2H); 2.78 (t, 2H); 2.63 (t, 2H); 2.32-2.19 (m, 4H); 1.73-1.20 (m, 24H); 0.89 (m, 3H)

Nonyl 8-((2-hydroxyethyl)((9Z,12Z)-octadeca-9,12-dien-1-yl)amino)octanoate

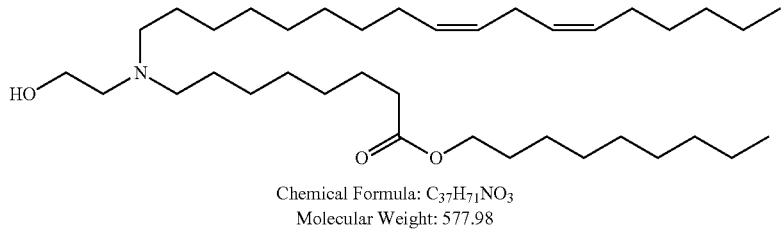 [SMILES: CCCCC/C=C\C/C=C\CCCCCCCCN(CCO)CCCCCCCC(=O)OCCCCCCCCC]

Chemical Formula: C$_{37}$H$_{71}$NO$_3$
Molecular Weight: 577.98

A solution of nonyl 8-((2-hydroxyethyl)amino)octanoate (150 mg, 0.46 mmol), (6Z,9Z)-18-bromooctadeca-6,9-diene (165 mg, 0.5 mmol) and N,N-diisopropylethylamine (65 mg, 0.5 mmol) in ethanol (2 mL) was allowed to stir at reflux for 48 h. The reaction was allowed to cool to rt and solvents were evaporated under vacuum. The residue was purified by silica gel chromatography (0-10% MeOH in dichloromethane) to obtain nonyl 8-((2-hydroxyethyl)((9Z,12Z)-octadeca-9,12-dien-1-yl)amino)octanoate (81 mg, 0.14 mmol, 30%) as a HBr salt.

UPLC/ELSD: RT=3.24 min. MS (ES): m/z (MH$^+$) 578.64 for C$_{37}$H$_{71}$NO$_3$ $^1$H NMR (300 MHz, CDCl$_3$) δ: ppm 10.71 (br., 1H); 5.36 (br. m, 4H); 4.04 (m, 4H); 3.22-2.96 (br. m, 5H); 2.77 (m, 2H); 2.29 (m, 2H); 2.04 (br. m, 4H); 1.86 (br. m, 4H); 1.66-1.17 (br. m, 40H); 0.89 (m, 6H)

E. Compound 138: Dinonyl 8,8'-((2-hydroxyethyl)azanediyl)dioctanoate

Representative Procedure 3:

Dinonyl 8,8'-((2-hydroxyethyl)azanediyl)dioctanoate

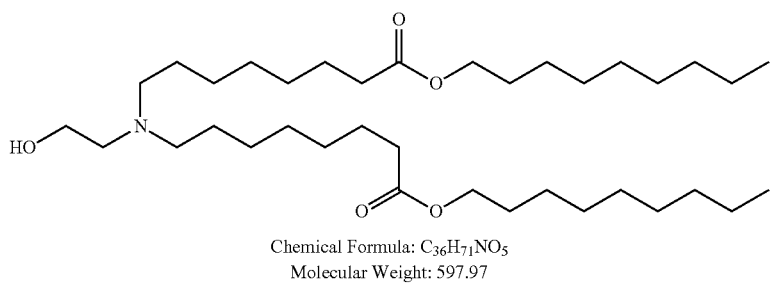 [SMILES: CCCCCCCCCOC(=O)CCCCCCCN(CCO)CCCCCCCC(=O)OCCCCCCCCC]

Chemical Formula: C$_{36}$H$_{71}$NO$_5$
Molecular Weight: 597.97

A solution of nonyl 8-bromooctanoate (200 mg, 0.6 mmol) and 2-aminoethan-1-ol (16 mg, 0.3 mmol) and N,N-diisopropylethylamine (74 mg, 0.6 mmol) in THF/CH$_3$CN (1:1) (3 mL) was allowed to stir at 63° C. for 72 h. The reaction was cooled to rt and solvents were evaporated under vacuum. The residue was extracted with ethyl acetate and saturated sodium bicarbonate. The organic layer was separated, dried over Na$_2$SO$_4$ and evaporated under vacuum. The residue was purified by silica gel chromatography (0-10% MeOH in dichloromethane) to obtain dinonyl 8,8'-((2-hydroxyethyl)azanediyl)dioctanoate (80 mg, 0.13 mmol, 43%).

UPLC/ELSD: RT=3.09 min. MS (ES): m/z (MH$^+$) 598.85 for C$_{36}$H$_{71}$NO$_5$ $^1$H NMR (300 MHz, CDCl$_3$) δ: ppm 4.05 (m, 4H); 3.57 (br. m, 2H); 2.71-2.38 (br. m, 6H); 2.29 (m, 4H), 1.71-1.01 (br. m, 49H), 0.88 (m, 6H).

All other compounds of Formula (I) of this disclosure can be obtained by a method analogous to Representative Procedures 1-3 as described above.

Example 21

Production of Nanoparticle Compositions

A. Production of Nanoparticle Compositions

Nanoparticles can be made with mixing processes such as microfluidics and T-junction mixing of two fluid streams, one of which contains the polynucleotide and the other has the lipid components.

Lipid compositions are prepared by combining a lipid according to Formula (I), a phospholipid (such as DOPE or DSPC, obtainable from Avanti Polar Lipids, Alabaster, AL), a PEG lipid (such as 1,2-dimyristoyl-sn-glycerol methoxypolyethylene glycol, also known as PEG-DMG, obtainable from Avanti Polar Lipids, Alabaster, AL), and a structural lipid (such as cholesterol, obtainable from Sigma-Aldrich, Taufkirchen, Germany, or a corticosteroid (such as prednisolone, dexamethasone, prednisone, and hydrocortisone), or a combination thereof) at concentrations of about 50 mM in ethanol. Solutions should be refrigerated for storage at, for example, −20° C. Lipids are combined to yield desired molar ratios and diluted with water and ethanol to a final lipid concentration of between about 5.5 mM and about 25 mM.

Nanoparticle compositions including a polynucleotide and a lipid composition are prepared by combining the lipid solution with a solution including the a polynucleotide at lipid composition to polynucleotide wt:wt ratios between about 5:1 and about 50:1. The lipid solution is rapidly injected using a NanoAssemblr microfluidic based system at flow rates between about 10 ml/min and about 18 ml/min into the polynucleotide solution to produce a suspension with a water to ethanol ratio between about 1:1 and about 4:1.

For nanoparticle compositions including an RNA, solutions of the RNA at concentrations of 0.1 mg/ml in deionized water are diluted in 50 mM sodium citrate buffer at a pH between 3 and 4 to form a stock solution.

Nanoparticle compositions can be processed by dialysis to remove ethanol and achieve buffer exchange. Formulations are dialyzed twice against phosphate buffered saline (PBS), pH 7.4, at volumes 200 times that of the primary product using Slide-A-Lyzer cassettes (Thermo Fisher Scientific Inc., Rockford, IL) with a molecular weight cutoff of 10 kD. The first dialysis is carried out at room temperature for 3 hours. The formulations are then dialyzed overnight at 4° C. The resulting nanoparticle suspension is filtered through 0.2 µm sterile filters (Sarstedt, Nümbrecht, Germany) into glass vials and sealed with crimp closures. Nanoparticle composition solutions of 0.01 mg/ml to 0.10 mg/ml are generally obtained.

The method described above induces nano-precipitation and particle formation. Alternative processes including, but not limited to, T-junction and direct injection, can be used to achieve the same nano-precipitation.

B. Characterization of Nanoparticle Compositions

A Zetasizer Nano ZS (Malvern Instruments Ltd, Malvern, Worcestershire, UK) can be used to determine the particle size, the polydispersity index (PDI) and the zeta potential of the nanoparticle compositions in 1× PBS in determining particle size and 15 mM PBS in determining zeta potential.

Ultraviolet-visible spectroscopy can be used to determine the concentration of a polynucleotide (e.g., RNA) in nanoparticle compositions. 100 µL of the diluted formulation in 1× PBS is added to 900 µL of a 4:1 (v/v) mixture of methanol and chloroform. After mixing, the absorbance spectrum of the solution is recorded, for example, between 230 nm and 330 nm on a DU 800 spectrophotometer (Beckman Coulter, Beckman Coulter, Inc., Brea, CA). The concentration of polynucleotide in the nanoparticle composition can be calculated based on the extinction coefficient of the polynucleotideused in the composition and on the difference between the absorbance at a wavelength of, for example, 260 nm and the baseline value at a wavelength of, for example, 330 nm.

For nanoparticle compositions including an RNA, a QUANT-IT™ RIBOGREEN® RNA assay (Invitrogen Corporation Carlsbad, CA) can be used to evaluate the encapsulation of an RNA by the nanoparticle composition. The samples are diluted to a concentration of approximately 5 µg/mL in a TE buffer solution (10 mM Tris-HCl, 1 mM EDTA, pH 7.5). 50 µL of the diluted samples are transferred to a polystyrene 96 well plate and either 50 µL of TE buffer or 50 µL of a 2% Triton X-100 solution is added to the wells. The plate is incubated at a temperature of 37° C. for 15 minutes. The RIBOGREEN® reagent is diluted 1:100 in TE buffer, and 100 µL of this solution is added to each well. The fluorescence intensity can be measured using a fluorescence plate reader (Wallac Victor 1420 Multilablel Counter; Perkin Elmer, Waltham, MA) at an excitation wavelength of, for example, about 480 nm and an emission wavelength of, for example, about 520 nm. The fluorescence values of the reagent blank are subtracted from that of each of the samples and the percentage of free RNA is determined by dividing the fluorescence intensity of the intact sample (without addition of Triton X-100) by the fluorescence value of the disrupted sample (caused by the addition of Triton X-100).

Exemplary formulations of the nanoparticle compositions are presented in the TABLE 5 below.

TABLE 5

Exemplary Formulations of Nanoparticles

| Composition (mol %) | Components |
|---|---|
| 40:20:38.5:1.5 | Compound:Phospholipid:Chol:PEG-DMG |
| 45:15:38.5:1.5 | Compound:Phospholipid:Chol:PEG-DMG |
| 50:10:38.5:1.5 | Compound:Phospholipid:Chol:PEG-DMG |
| 55:5:38.5:1.5 | Compound:Phospholipid:Chol:PEG-DMG |
| 60:5:33.5:1.5 | Compound:Phospholipid:Chol:PEG-DMG |
| 45:20:33.5:1.5 | Compound:Phospholipid:Chol:PEG-DMG |
| 50:20:28.5:1.5 | Compound:Phospholipid:Chol:PEG-DMG |
| 55:20:23.5:1.5 | Compound:Phospholipid:Chol:PEG-DMG |
| 60:20:18.5:1.5 | Compound:Phospholipid:Chol:PEG-DMG |
| 40:15:43.5:1.5 | Compound:Phospholipid:Chol:PEG-DMG |
| 50:15:33.5:1.5 | Compound:Phospholipid:Chol:PEG-DMG |
| 55:15:28.5:1.5 | Compound:Phospholipid:Chol:PEG-DMG |
| 60:15:23.5:1.5 | Compound:Phospholipid:Chol:PEG-DMG |
| 40:10:48.5:1.5 | Compound:Phospholipid:Chol:PEG-DMG |
| 45:10:43.5:1.5 | Compound:Phospholipid:Chol:PEG-DMG |
| 55:10:33.5:1.5 | Compound:Phospholipid:Chol:PEG-DMG |
| 60:10:28.5:1.5 | Compound:Phospholipid:Chol:PEG-DMG |
| 40:5:53.5:1.5 | Compound:Phospholipid:Chol:PEG-DMG |
| 45:5:48.5:1.5 | Compound:Phospholipid:Chol:PEG-DMG |
| 50:5:43.5:1.5 | Compound:Phospholipid:Chol:PEG-DMG |
| 40:20:40:0 | Compound:Phospholipid:Chol:PEG-DMG |
| 45:20:35:0 | Compound:Phospholipid:Chol:PEG-DMG |
| 50:20:30:0 | Compound:Phospholipid:Chol:PEG-DMG |
| 55:20:25:0 | Compound:Phospholipid:Chol:PEG-DMG |
| 60:20:20:0 | Compound:Phospholipid:Chol:PEG-DMG |
| 40:15:45:0 | Compound:Phospholipid:Chol:PEG-DMG |
| 45:15:40:0 | Compound:Phospholipid:Chol:PEG-DMG |
| 50:15:35:0 | Compound:Phospholipid:Chol:PEG-DMG |
| 55:15:30:0 | Compound:Phospholipid:Chol:PEG-DMG |
| 60:15:25:0 | Compound:Phospholipid:Chol:PEG-DMG |
| 40:10:50:0 | Compound:Phospholipid:Chol:PEG-DMG |
| 45:10:45:0 | Compound:Phospholipid:Chol:PEG-DMG |
| 50:10:40:0 | Compound:Phospholipid:Chol:PEG-DMG |
| 55:10:35:0 | Compound:Phospholipid:Chol:PEG-DMG |
| 60:10:30:0 | Compound:Phospholipid:Chol:PEG-DMG |

It is to be appreciated that the Detailed Description section, and not the Summary and Abstract sections, is intended to be used to interpret the claims. The Summary and Abstract sections can set forth one or more but not all exemplary embodiments of the present disclosure as contemplated by the inventor(s), and thus, are not intended to limit the present disclosure and the appended claims in any way.

The present disclosure has been described above with the aid of functional building blocks illustrating the implementation of specified functions and relationships thereof. The boundaries of these functional building blocks have been arbitrarily defined herein for the convenience of the description. Alternate boundaries can be defined so long as the specified functions and relationships thereof are appropriately performed.

The foregoing description of the specific embodiments will so fully reveal the general nature of the present disclosure that others can, by applying knowledge within the skill of the art, readily modify and/or adapt for various applications such specific embodiments, without undue experimentation, without departing from the general concept of the present disclosure. Therefore, such adaptations and modifications are intended to be within the meaning and range of equivalents of the disclosed embodiments, based on the teaching and guidance presented herein. It is to be understood that the phraseology or terminology herein is for the purpose of description and not of limitation, such that the terminology or phraseology of the present specification is to be interpreted by the skilled artisan in light of the teachings and guidance.

The breadth and scope of the present disclosure should not be limited by any of the above-described exemplary embodiments, but should be defined only in accordance with the following claims and their equivalents.

All publications, patent applications, patents, and other references mentioned herein are incorporated by reference in their entirety. In case of conflict, the present specification, including definitions, will control.

LENGTHY TABLES

The patent contains a lengthy table section. A copy of the table is available in electronic form from the USPTO web site (https://seqdata.uspto.gov/?pageRequest=docDetail&DocID=US11801227B2). An electronic copy of the table will also be available from the USPTO upon request and payment of the fee set forth in 37 CFR 1.19(b)(3).

SEQUENCE LISTING (168 sequences)

SEQ ID NO: 1 - protein, 1480 aa, Homo sapiens
MQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEEGFGELFEKAKQNNNNRKTSNGDDSLFFSNFSLLGTPVLKDINFKIERGQLLAVAGSTGAGKTSLLMVIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILHEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTRKVSLAPQANLTELDIYSRRLSQETGLEISEEINEEDLKECFFDDMESIPAVTTWNTYLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVGLLGRTGSGKSTLLSAFLRLLNTEGEIQIDGVSWDSITLQQWRKAFGVIPQKVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLVIEENKVRQYDSIQKLLNERSLFRQAISPSDRVKLFPHRNSSKCKSKPQIAALKEETEEEVQDTRL

SEQ ID NO: 2 - protein, 4440 aa, Artificial Sequence
  Synthetic polypeptide
ATGCAGAGGTCGCCTCTGGAAAAGGCCAGCGTTGTCTCCAAACTTTTTTTCAGCTGGACCAGACCAATTTTGAGGAAAGGATACAGACAGCGCCTGGAATTGTCAGACATATACCAAATCCCTTCTGTTGATTCTGCTGACAATCTATCTGAAAAATTGGAAAGAGAATGGGATAGAGAGCTGGCTTCAAAGAAAAATCCTAAACTCATTAATGCCCTTCGGCGATGTTTTTTCTGGAGATTTATGTTCTATGGAATCTTTTTATATTTAGGGGAAGTCACCAAAGCAGTACAGCCTCTCTTACTGGGAAGAATCATAGCTTCCTATGACCCGGATAACAAGGAGGAACGCTCTATCGCGATTTATCTAGGCATAGGCTTATGCCTTCTCTTTATTGTGAGGACACTGCTCCTACACCCAGCCATTTTTGGCCTTCATCACATTGGAATGCAGATGAGAATAGCTATGTTTAGTTTGATTTATAAGAAGACTTTAAAGCTGTCAAGCCGTGTTCTAGATAAAATAAGTATTGGACAACTTGTTAGTCTCCTTTCCAACAACCTGAACAAATTTGATGAAGGACTTGCATTGGCACATTTCGTGTGGATCGCTCCTTTGCAAGTGGCACTCCTCATGGGGCTAATCTGGGAGTTGTTACAGGCGTCTGCCTTCTGTGGACTTGGTTTCCTGATAGTCCTTGCCCTTTTTCAGGCTGGGCTAGGGAGAATGATGATGAAGTACAGAGATCAGAGAGCTGGGAAGATCAGTGAAAGACTTGTGATTACCTCAGAAATGATTGAAAATATCCAATCTGTTAAGGCATACTGCTGGGAAGAAGCAATGGAAAAAATGATTGAAAACTTAAGACAAACAGAACTGAAACTGACTCGGAAGGCAGCCTATGTGAGATACTTCAATAGCTCAGCCTTCTTCTTCTCAGGGTTCTTTGTGGTGTTTTTATCTGTGCTTCCCTATGCACTAATCAAAGGAATCATCCTCCGGAAAATATTCACCACCATCTCATTCTGCATTGTTCTGCGCATGGCGGTCACTCGGCAATTTCCCTGGGCTGTACAAACATGGTATGACTCTCTTGGAGCAATAAACAAAATACAGGATTTCTTACAAAAGCAAGAATATAAGACATTGGAATATAACTTAACGACTACAGAAGTAGTGATGGAGAATGTAACAGCCTTCTGGGAGGAGGGATTTGGGGAATTATTTGAGAAAGCAAAACAAAACAATAACAATAGAAAAACTTCTAATGGTGATGACAGCCTCTTCTTCAGTAATTTCTCACTTCTTGGTACTCCTGTCCTGAAAGATATTAATTTCAAGATAGAAAGAGGACAGTTGTTGGCGGTTGCTGGATCCACTGGAGCAGGCAAGACTTCACTTCTAATGGTGATTATGGGAGAACTGGAGCCTTCAGAGGGTAAAATTAAGCACAGTGGAAGAATTTCATTCTGTTCTCAGTTTTCCTGGATTATGCCTGGCACCATTAAAGAAAATATCATCTTTGGTGTTTCCTATGATGAATATAGATACAGAAGCGTCATCAAAGCATGCCAACTAGAAGAGGACATCTCCAAGTTTGCAGAGAAAGACAATATAGTTCTTGGAGAAGGTGGAATCACACTGAGTGGAGGTCAACGAGCAAGAATTTCTTTAGCAAGAGCAGTATACAAAGATGCTGATTTGTATTTATTAGACTCTCCTTTTGGATACCTAGATGTTTTAACAGAAAAAGAAATATTTGAAAGCTGTGTCTGTAAACTGATGGCTAACAAAACTAGGATTTTGGTCACTTCTAAAATGGAACATTTAAAGAAAGCTGACAAAATATTAATTTTGCATGAAGGTAGCAGCTATTTTTATGGGACATTTTCAGAACTCCAAAATCTACAGCCAGACTTTAGCTCAAAACTCATGGGATGTGATTCTTTCGACCAATTTAGTGCAGAAAGAAGAAATTCAATCCTAACTGAGACCTTACACCGTTTCTCATTAGAAGGAGATGCTCCTGTCTCCTGGACAGAAACAAAAAAACAATCTTTTAAACAGACTGGAGAGTTTGGGGAAAAAAGGAAGAATTCTATTCTCAATCCAATCAACTCTATACGAAAATTTTCCATTGTGCAAAAGACTCCCTTACAAATGAATGGCATCGAAGAGGATTCTGATGAGCCTTTAGAGAGAAGGCTGTCCTTAGTACCAGATTCTGAGCAGGGAGAGGCGATACTGCCTCGCATCAGCGTGATCAGCACTGGCCCCACGCTTCAGGCACGAAGGAGGCAGTCTGTCCTGAACCTGATGACACACTCAGTTAACCAAGGTCAGAACATTCACCGAAAGACAACAGCATCCACACGAAAAGTGTCACTGGCCCCTCAGGCAAACTTGACTGAACTGGATATATATTCAAGAAGGTTATCTCAAGAAACTGGCTTGGAAATAAGTGAAGAAATTAACGAAGAAGACTTAAAGGAGTGCTTTTTTGATGATATGGAGAGCATACCAGCAGTGACTACATGGAACACATACCTTCGATATATTACTGTCCACAAGAGCTTAATTTTTGTGCTAATTTGGTGCTTAGTAATTTTTCTGGCAGAGGTGGCTGCTTCTTTGGTTGTGCTGTGGCTCCTTGGAAACACTCCTCTTCAAGACAAAGGGAATAGTACTCATAGTAGAAATAACAGCTATGCAGTGATTATCACCAGCACCAGTTCGTATTATGTGTTTTACATTTACGTGGGAGTAGCCGACACTTTGCTTGCTATGGGATTCTTCAGAGGTCTACCACTGGTGCATACTCTAATCACAGTGTCGAAAATTTTACACCACAAAATGTTACATTCTGTTCTTCAAGCACCTATGTCAACCCTCAACACGTTGAAAGCAGGTGGGATTCTTAATAGATTCTCCAAAGATATAGCAATTTTGGATGACCTTCTGCCTCTTACCATATTTGACTTCATCCAGTTGTTATTAATTGTGATTGGAGCTATAGCAGTTGTCGCAGTTTTACAACCCTACATCTTTGTTGCAACAGTGCCAGTGATAGTGGCTTTTATTATGTTGAGAGCATATTTCCTCCAAACCTCACAGCAACTCAAACAACTGGAATCTGAAGGCAGGAGTCCAATTTTCACTCATCTTGTTACAAGCTTAAAAGGACTATGGACACTTCGTGCCTTCGGACGGCAGCCTTACTTTGAAACTCTGTTCCACAAAGCTCTGAATTTACATACTGCCAACTGGTTCTTGTACCTGTCAACACTGCGCTGGTTCCAAATGAGAATAGAAATGATTTTTGTCATCTTCTTCATTGCTGTTACCTTCATTTCCATTTTAACAACAGGAGAAGGAGAAGGAAGAGTTGGTATTATCCTGACTTTAGCCATGAATATCATGAGTACATTGCAGTGGGCTGTAAACTCCAGCATAGATGTGGATAGCTTGATGCGATCTGTGAGCCGAGTCTTTAAGTTCATTGACATGCCAACAGAAGGTAAACCTACCAAGTCAACCAAACCATACAAGAATGGCCAACTCTCGAAAGTTATGATTATTGAGAATTCACACGTGAAGAAAGATGACATCTGGCCCTCAGGGGGCCAAATGACTGTCAAAGATCTCACAGCAAAATACACAGAAGGTGGAAATGCCATATTAGAGAACATTTCCTTCTCAATAAGTCCTGGCCAGAGGGTGGGCCTCTTGGGAAGAACTGGATCAGGGAAGAGTACTTTGTTATCAGCTTTTTTGAGACTACTGAACACTGAAGGAGAAATCCAGATCGATGGTGTGTCTTGGGATTCAATAACTTTGCAACAGTGGAGGAAAGCCTTTGGAGTGATACCACAGAAAGTATTTATTTTTTCTGGAACATTTAGAAAAAACTTGGATCCCTATGAACAGTGGAGTGATCAAGAAATATGGAAAGTTGCAGATGAGGTTGGGCTCAGATCTGTGATAGAACAGTTTCCTGGGAAGCTTGACTTTGTCCTTGTGGATGGGGGCTGTGTCCTAAGCCATGGCCACAAGCAGTTGATGTGCTTGGCTAGATCTGTTCTCAGTAAGGCGAAGATCTTGCTGCTTGATGAACCCAGTGCTCATTTGGATCCAGTAACATACCAAATAATTAGAAGAACTCTAAAACAAGCATTTGCTGATTGCACAGTAATTCTCTGTGAACACAGGATAGAAGCAATGCTGGAATGCCAACAATTTTTGGTCATAGAAGAGAACAAAGTGCGGCAGTACGATTCCATCCAGAAACTGCTGAACGAGAGGAGCCTCTTCCGGCAAGCCATCAGCCCCTCCGACAGGGTGAAGCTCTTTCCCCACCGGAACTCAAGCAAGTGCAAGTCTAAGCCCCAGATTGCTGCTCTGAAAGAGGAGACAGAAGAAGAGGTGCAAGATACAAGGCTT

SEQ ID NO: 3 - protein, 1419 aa, Homo sapiens
MQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEETSLLMVIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILHEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTRKVSLAPQANLTELDIYSRRLSQETGLEISEEINEEDLKECFFDDMESIPAVTTWNTYLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVGLLGRTGSGKSTLLSAFLRLLNTEGEIQIDGVSWDSITLQQWRKAFGVIPQKVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLVIEENKVRQYDSIQKLLNERSLFRQAISPSDRVKLFPHRNSSKCKSKPQIAALKEETEEEVQDTRL

SEQ ID NO: 4 - protein, 604 aa, Homo sapiens
MQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEEGFGELFEKAKQNNNNRKTSNGDDSLFFSNFSLLGTPVLKDINFKIERGQLLAVAGSTGAGKTSLLMVIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFERRRCSCLLDRNKKTIF

SEQ ID NO: 5 - DNA, 4440 bp, Artificial Sequence
  Synthetic polynucleotide
atgcagaggagccccctcgaaaaggccagcgtggtcagcaagctgttcttctcctggacccggcccattctccggaagggctacaggcagaggctggagctgagcgatatctaccagatccccagcgtggatagcgccgataacctgagcgaaaagctcgaacgggagtgggacagggagctggccagcaaaaagaaccccaaactgatcaacgccttgaggaggtgcttcttctggcgtttcatgttctacggcatcttcctgtacctgggtgaggtaaccaaggccgtccagcccctgctgctgggccgtatcatcgccagctatgatccagacaataaggaggagaggagcatcgccatatacctgggcatcgggctctgcctcctgttcatcgtccgaaccctgctgctgcaccctgccatctttgggctgcaccacatcggcatgcagatgaggatcgccatgttttccctgatctacaagaagaccctgaagctgtcctcacgggtgctggataagatcagcatcggccagctggtgtccctgctgagcaacaacctgaacaagttcgatgagggtctggcgctggcccacttcgtgtggatcgcccccctgcaggtggccctgctaatgggcctgatctgggagctgctgcaggccagcgccttctgcggcctgggcttcctgatcgtgctggccctgttccaggccgggctgggcaggatgatgatgaagtacagggaccagagggcaggcaagatctccgagcggctggtgatcacctccgagatgatcgagaacatccagagcgtcaaggcctactgctgggaggaggccatggagaagatgatcgagaacctgaggcagactgagctgaaactgaccaggaaggccgcctatgtgaggtactttaacagcagcgccttctttttcagcgggttcttcgtcgtattcctcagcgtactgccctacgccctcatcaaggggatcatcctccggaagatcttcacaaccatctccttctgcattgtgctgcggatggccgtgacccggcagttcccgtgggccgtgcagacgtggtacgactcactgggcgccatcaacaagatccaggattttctacagaagcaggagtacaaaaccctggagtacaacctcacgacgaccgaggtggtgatggagaacgtgaccgccttctgggaggagggcttcggagagctgttcgagaaggccaagcaaaataacaacaacaggaaaaccagcaatggcgacgactccctgtttttttccaactttagtctgctgggcaccccagtactgaaggacatcaacttcaagatcgagcgaggccagctcctggccgtggccgggagcaccggcgccggaaagacctccctgctgatggtgatcatgggcgagctcgagccgtccgagggcaagatcaagcacagcggccggatcagcttctgcagccaattcagctggatcatgcccggcaccatcaaggagaatatcatcttcggggtgagctatgacgagtacaggtaccggagcgtaatcaaagcgtgccagctggaggaggacatctccaagtttgccgagaaggacaatatcgtgctgggcgagggtggcatcaccctcagcggcggccagcgggccaggatcagcctggcccgggccgtgtacaaggacgctgatctctacctgctggacagcccattcggctacctggacgtgctgaccgagaaggaaattttcgagtcctgcgtgtgcaagctgatggccaacaaaaccaggatcctggtgaccagcaaaatggagcatctgaagaaggccgacaagatcctcatcctgcatgaaggcagctcctacttctacggtaccttctccgagctccagaacctccagcccgactttagcagcaagctcatgggctgcgacagcttcgatcagttcagcgccgagaggaggaactccattctgaccgaaaccttgcataggttttccctggagggcgatgcccccgtgagctggaccgagaccaagaaacagagcttcaagcagaccggcgaatttggggagaagaggaagaactccatcctgaatcccataaacagcatcaggaaattcagcatcgtgcaaaaaacccccctccagatgaatgggatcgaggaggactcggatgagcccctcgagcggaggctgagcctggtgccagactccgagcagggcgaggcaatcctgcccaggatcagcgttatcagcaccgggccgaccctgcaggccaggcgccggcaaagcgtgctcaacctgatgacccactccgtcaaccagggccagaatatccaccgcaagaccaccgccagcaccaggaaggtgagcctggccccgcaggccaacctaaccgagctggacatctactcccggcggctgagccaggaaacgggcctggagatcagcgaagagatcaacgaggaggacctgaaggagtgtttcttcgacgatatggagagcatccccgccgtgaccacctggaacacctatctgcggtatatcaccgtgcataagtccttaatcttcgtgctgatctggtgcctggtgatcttcctggcggaggtggccgccagcctggtggtgctgtggctgctggggaacacgcccctgcaggataagggcaacagcacccacagcaggaacaatagctacgcggtaatcatcaccagcacatccagctactacgtcttctacatctacgtgggcgtagccgacaccctcctggccatggggttcttccgcgggctgcccctggtgcacaccctcatcaccgtgagcaaaatcctgcaccataagatgctgcattccgtgctccaggcccccatgagcaccctgaacaccctgaaggcgggcggaatcctcaaccggttcagcaaggacatcgccatcctggacgacctgctgcccctcaccatcttcgactttatccagctgctgctgatcgtcatcggggccatagccgtggtggccgttctgcagccttacatcttcgtggccaccgtccccgtgatcgtggccttcatcatgctgcgggcctacttcctgcaaacctcccagcagctgaagcagctggaaagcgagggccggtcaccgatcttcacccatctggtcaccagcctgaaaggcctgtggaccctgagggccttcggccggcagccctacttcgagaccttgttccacaaggcgctgaacctgcacaccgccaactggtttctgtacctgagcaccctgcggtggttccagatgaggatcgagatgatcttcgtgatcttcttcatagccgtgaccttcatcagcatactgaccaccggggaaggcgagggcagggtcggcatcatcctcaccctggccatgaacatcatgagcaccctgcagtgggcggtgaacagctccatcgatgtggacagcctgatgaggtccgtgagtcgggtgttcaagttcatcgacatgcccaccgagggcaaacctaccaaatccaccaaaccctacaagaacgggcaactgagcaaggtgatgataatcgagaacagccacgtgaagaaggacgacatctggccctccggcgggcagatgaccgtgaaagacctgaccgccaagtacaccgagggcggcaatgccatcctggagaacatcagcttcagcatctccccgggtcagagggtgggcctgctggggcgcaccggctccggcaagagcaccctgctgagcgcgttcctgagactgctgaacaccgagggcgagattcaaatcgacggtgtgagctgggatagcatcacgctgcagcagtggaggaaggcattcggggtgatcccgcaaaaagtattcatattcagcggcacctttcgcaagaacctggacccctacgagcagtggtccgaccaggagatatggaaggttgccgacgaggtgggcctgagaagcgtgatagaacaattccccggcaagctggatttcgtgctcgtggatgggggctgtgtcctctctcacggccacaagcagctgatgtgcctggcccggagcgtgctgtccaaggcaaagatcctgctgctggacgagcccagcgcacacctcgaccccgtgacttaccagatcataaggcgtacgctgaagcaggccttcgccgactgcaccgtgatcctctgcgagcataggatcgaggccatgctggagtgccagcagttcctcgtgatagaggagaacaaagtcaggcaatacgactccatccagaagctgctcaatgagagatccctgttccggcaggccatcagcccgagcgacagggtgaagctgttcccccatcgaaacagctccaagtgcaagtccaagccccagatcgcggctctgaaggaggagacggaggaagaggtgcaggataccaggctg

SEQ ID NO: 6 - DNA, 4440 bp, Artificial Sequence
  Synthetic polynucleotide
atgcagaggagccccctggagaaagccagcgtggtcagcaagctgttttttagctggaccaggccgatcctgcgcaagggctacaggcagaggctggaactgagcgacatataccagatccccagcgtggacagcgccgacaacctgagcgagaagctcgagcgcgagtgggaccgggagctggccagcaagaagaacccgaagctgatcaacgccctcaggcgctgcttcttctggcggttcatgttctacggcatcttcctgtacctcggggaggtgacaaaggccgttcagccgctgctgctgggccgtatcatcgcgagctacgaccccgacaacaaggaggaaaggtccatcgccatctatctgggcatcggcctgtgtctccttttcatcgtgaggaccctgctcctgcaccccgccatcttcggcctgcatcacattggcatgcagatgaggatagcgatgttcagcctgatatacaagaaaacactgaagctctcctccagggtcctggacaagatcagcatcgggcagctggtgtccctgctgagcaacaacctgaacaagttcgacgagggcctcgccctggcccacttcgtctggatcgcccccctgcaagtggccctgctgatgggcctgatctgggagctgctccaggcgagcgccttttgcgggctgggcttcctgatcgtgctggccctattccaggcgggcctgggcaggatgatgatgaagtacagggaccagagggccggcaagatatccgagaggctcgtgatcaccagcgagatgatcgagaatatccagtcggtgaaggcctactgctgggaggaggccatggagaagatgatcgagaacctgaggcagaccgagctgaagctcaccagaaaggccgcatacgtcaggtacttcaacagctccgccttcttcttcagcggcttcttcgtggtgttcctgtccgtgctgccctatgcgctgatcaagggaatcatcctgcggaaaatctttaccaccatctccttctgcatcgtgctgaggatggccgtgacccgccagttcccctgggcggtgcaaacctggtacgacagcctgggggccatcaacaagatccaggacttcctgcaaaagcaagagtacaagaccctggaatacaacctgaccaccaccgaagtcgtcatggagaatgtgaccgccttctgggaggagggtttcggcgagctgtttgaaaaagccaagcagaacaacaacaaccgtaagacctccaacggtgacgacagcctctttttctccaacttcagcctgctcggcactcccgtcctgaaggacatcaatttcaagattgaacgggggcagctcctggccgtggccgggagcaccggagccgggaagaccagcctgctgatggtcatcatgggcgaactggagccctccgagggcaaaatcaagcacagcggcaggatcagcttctgcagccagttcagctggatcatgcctggcaccatcaaggagaacatcatcttcggcgtgagctacgacgagtaccggtacagaagcgtgatcaaagcctgccagctcgaagaggacatcagcaagttcgcggaaaaggacaatatcgtgctgggcgagggcggcatcaccctgagcggcggccagcgggctcggatctccctcgccagggccgtgtacaaggacgccgacctctatctgctggacagccccttcggttacctggatgtcctgaccgagaaggaaatcttcgagagctgcgtctgtaagctgatggccaacaagactcgcatactggtgaccagcaagatggagcacctgaagaaggcggacaagatcctgatcctgcacgagggcagcagctacttctacggcaccttcagcgaactgcagaatctgcagcccgacttctcctccaagctgatgggctgcgactccttcgatcagttcagcgccgaaaggcgtaatagcatcctcacagagaccctccatcgcttcagcctggagggcgacgcccccgtcagctggaccgagacgaagaagcagagcttcaagcagaccggcgagttcggcgagaagcggaagaactccatcctcaacccgatcaacagcatccgcaagttcagcatcgtgcagaagacccccctgcagatgaacggcatagaggaggactccgatgaacccctggagaggaggctgagcctggtgcctgactctgaacagggggaggcgatcctgcctagaatatccgtcatatccaccggccccaccctgcaggcaaggaggcgacagagtgtgctgaatctcatgacccacagtgtgaaccagggacagaacatccatcgcaagaccaccgcctccacccgtaaggtgtcgctggccccccaggccaacctcacggaactggatatctactctcgaaggctgagccaggagaccggtctcgaaatctccgaggagattaacgaggaggacctcaaggagtgttttttcgatgatatggagtccatccccgccgtgaccacctggaacacctatctgcgttatatcaccgtgcacaagagcctgatcttcgtgctgatatggtgcctggtgatcttcctcgccgaggtggccgcctccctggtcgtgctctggctgctgggtaacacccccctgcaagacaagggcaactccacacacagccggaacaacagctacgccgtgatcatcacctccaccagcagctactatgtgttctacatctacgtcggcgtggccgacaccctgctggccatgggcttctttcgcgggctgccgcttgtgcacaccctgatcaccgtgagcaagatcctgcaccacaagatgctgcactccgtgctacaggcgcccatgagcaccctgaacacgctgaaagccggaggcatcctgaataggttctcaaaggatatcgccatcctggacgacctgctccccctgaccatcttcgatttcattcagctactgcttatagtgatcggggccatcgccgtggtcgccgtcctccaaccctacatcttcgtggcgaccgtgcccgtgatcgtcgccttcatcatgctgagggcctactttctacagacctcccaacagcttaagcagctggagagcgagggccgcagcccgatcttcacccacctggtcaccagcctgaagggcctctggaccctgagggccttcggcaggcaaccttacttcgagaccctgttccacaaggccctgaatctccacaccgccaactggttcctctatctcagcaccctgaggtggttccagatgaggatcgagatgatctttgtgatcttcttcatcgccgtcaccttcatcagcatcctgaccactggcgagggtgaggggcgcgtgggcatcatcctcaccctggccatgaacataatgagcaccctgcagtgggccgtgaatagcagcatcgacgtggactcactgatgcggtccgtctccagggtcttcaagtttatcgacatgcccaccgagggaaagcccaccaagagcaccaagccgtacaagaacggccagctgagcaaggtgatgatcatcgagaacagccatgtaaagaaagacgacatctggccttccggcgggcagatgaccgtgaaagacctgaccgccaagtataccgaaggcggcaacgccatcctggagaacataagctttagcatcagccccggccagagggtgggtctgctgggccgcacgggcagcggaaaaagcaccctcctgtccgcgttcctgcggctgctgaataccgagggcgagatccagatcgacggagtcagctgggactccatcaccctgcagcagtggaggaaggcctttggtgtgatcccccagaaggtgttcatcttcagcggcacctttcgcaagaacctggacccctatgagcaatggagcgaccaggagatctggaaggtggccgatgaggtggggctgaggagcgtaatcgagcagttccccggcaaactagacttcgtgctggtggacggagggtgcgtgctcagccacggacacaaacagctgatgtgcctggccaggagcgtcctcagcaaggccaagatactgctgctggacgagccctccgcccacctggaccccgttacgtaccagatcatcaggaggaccctgaagcaggccttcgccgactgcaccgtgatcctgtgcgagcacaggatcgaggccatgctggagtgtcagcagttccttgtcatcgaggagaataaagtgaggcagtacgactccatccagaagctgctgaacgagcggtcactgtttcggcaagccatcagcccctccgaccgcgtgaagctgttcccccaccgcaatagcagcaaatgcaaatccaaaccccagatcgccgccctgaaggaggagaccgaggaggaggtccaagataccaggctg

SEQ ID NO: 7 - DNA, 4440 bp, Artificial Sequence
  Synthetic polynucleotide
atgcaacgctcgcccctggagaaggccagcgtggtgagcaagctgtttttctcctggacgaggcccatcctgcggaaaggctaccgccagcggctggagctgagcgacatctatcagatcccctcggtggacagcgctgacaacctctccgagaagctggagcgagagtgggatagggagctggccagcaagaagaacccaaagctgatcaacgccctgcgcaggtgctttttttggaggttcatgttctacggcatcttcctgtacctaggcgaagtgaccaaggccgtgcagcccctgctgctgggtcgcatcatcgccagctacgaccccgataacaaggaggagcgaagcatcgcgatctacctgggcatcggcctgtgcctgctgttcatcgtgaggaccctgctgctgcaccccgcgatcttcggcctgcaccacatcggcatgcagatgaggatcgccatgttctccctgatctacaagaagaccctcaagctcagcagccgggtgctggacaagatctccataggtcagctcgtgagcctgctgtccaataacctgaacaagttcgacgaaggcctcgcgctggcgcatttcgtgtggatcgccccgctgcaggtggctctgcttatgggcctgatctgggagctgctgcaggccagcgccttctgcggcctcgggttcctgatcgtgctggccctgttccaagccggcctcggcaggatgatgatgaaatacagggatcagagggccggcaagatctcagagaggctggtgatcacctccgagatgatcgaaaatatccagtccgtgaaggcgtattgttgggaagaggcaatggagaaaatgatcgagaacctgcggcagacggagctgaagctgactcggaaggcagcctatgtgcggtattttaacagcagcgcgttcttcttcagcggcttcttcgtcgtgttcctcagcgtgctgccctacgccctgatcaagggtatcatactgaggaaaatcttcaccaccatctcattctgcatcgtgctgcggatggccgtgacccggcagtttccgtgggcggtgcagacctggtacgacagcctgggcgccatcaacaagatccaggactttctccagaagcaggaatacaagaccctcgaatataacctgaccaccaccgaggtggtgatggagaacgtcaccgccttctgggaggaaggcttcggggagctcttcgagaaggccaagcagaataacaacaaccggaaaaccagcaatggcgacgacagcctgttcttcagcaacttttccctcctgggcacccccgtgctgaaggatatcaactttaagatcgagaggggccagctgctggccgtggccgggagcaccggcgccggcaaaacgagcctgctgatggtcatcatgggcgagctggaacccagcgagggcaagattaagcactccggccggatctctttctgttcccagttcagctggatcatgcccggcaccatcaaggagaacattatcttcggggtgagctacgacgaatatcgctacaggtccgtgatcaaggcgtgccaactggaggaggacatctccaagtttgccgagaaagacaacatcgtgctcggcgaggggggcatcacgttaagcggcggccagagggccagaatcagcctggccagggcggtgtacaaggatgccgacctctacctgctggacagcccctttggctacctggacgtgctcacggagaaggagatcttcgagagctgcgtgtgtaagctgatggccaacaaaacgcgcatcctggtgacctcgaagatggaacacctgaagaaggccgacaagatcctgatactgcacgagggaagctcctatttttacggcacttttagcgagctccagaacctgcagcccgacttcagcagcaagctgatgggctgcgatagcttcgaccagttctccgccgagaggcggaacagcatcctgacagagaccctgcacaggttcagcctcgagggggacgcccccgtgagctggaccgaaaccaaaaagcagagctttaagcagaccggcgagttcggcgaaaaacgaaagaacagcatcctgaacccgatcaatagcatccgtaagttcagcatagtgcagaaaacccccttgcagatgaacggcatagaggaggatagcgacgaaccgctcgagaggaggctgagcctggtcccagacagcgagcagggcgaggccattctccccagaatcagcgtgatcagcaccggccccaccctccaggcccgcaggaggcagtccgtgctgaacctgatgacccactccgtaaatcaggggcaaaacatccaccggaagacgaccgccagcacccgaaaggtgagcctggccccccaggccaacctgaccgagctcgacatttatagcaggaggctgtcccaggagactggcctcgagatttccgaggaaatcaacgaggaagacctgaaggagtgcttctttgatgacatggagtcgatccccgccgtgaccacctggaacacatacctgaggtacatcaccgtgcacaaaagcctgatcttcgtactcatctggtgcctggtgatctttctcgccgaggtggccgcctcgctggtggtcctgtggctgctgggcaacacccctctgcaggacaaaggcaactccacccacagcaggaacaatagctacgcggtgatcatcaccagcaccagctcctactacgtgttctacatctacgtcggcgtggccgacaccctgctggcgatgggcttcttcagggggctgccgctggtgcacaccctgatcaccgtgtccaaaatcctgcaccacaagatgctccactctgtgctgcaggcccccatgagcaccctgaacaccctgaaggccggcggcatcctgaaccggtttagcaaagacatcgccatcctggacgacctgctgcccctcaccatcttcgacttcattcagctgctcctgatcgtgatcggcgccatcgccgtcgtggccgtgctccagccctacatcttcgtcgccaccgtgccggtgatcgtggccttcatcatgctgagggcctacttcctgcagacgagccagcagctgaagcagctggaatccgaaggcaggagccccatcttcacccacctggtgacgtccctcaagggcctgtggacactgcgcgccttcggcaggcagccgtacttcgagaccctgttccacaaggccctgaacttacacaccgcgaattggttcctgtacctgtccaccctgcggtggttccagatgcggattgagatgatcttcgtgatcttctttatcgccgtgacgtttatatccatcctgacgaccggggagggggaaggcagggtggggatcatcctcaccctggccatgaacatcatgagcaccctgcagtgggcggtgaactccagcatcgacgtggacagcctgatgcgatcagtcagccgggtattcaagttcatcgatatgccgaccgaggggaagcccaccaagagcaccaagccctacaagaacgggcagctgtccaaggtgatgatcatcgagaacagccacgtgaagaaggacgacatctggccctccggcggtcagatgaccgtgaaggacctgaccgccaagtacaccgaaggcggcaacgccatcctggagaacatcagcttctccatcagcccggggcaaagggtggggctgctggggaggaccggcagcggcaaaagcacgctgctgtctgccttcctgaggctcctgaacaccgagggcgagatccagatcgacggcgtgtcctgggacagcatcaccctgcagcagtggcggaaggcctttggcgtgatcccgcaaaaggtcttcatcttcagcggtacgtttaggaagaatctggacccctatgagcagtggtcggatcaggagatttggaaggtggccgacgaggtgggcctgaggagcgtgatcgagcagttccccggaaaactggatttcgtgctggtggatggcggctgcgtcctgtcccacggccacaaacagctgatgtgtctggcccgcagcgtcctgtccaaggccaagatcctgctgctggacgagccgagcgctcatctcgatcctgtcacctaccagatcatccggaggaccctgaaacaggcattcgccgactgtacggtcatcctgtgtgaacaccgaatagaagccatgctggaatgccaacagttcctggtgatcgaggagaataaggtcaggcagtacgactccatccagaagctgctgaatgagcgatccctgttccggcaggccatctccccctccgatagggtgaagctgtttccacatcggaactccagtaaatgcaagagcaagccccagatcgccgccctgaaggaagagaccgaagaggaggtgcaggacacccgactg

SEQ ID NO: 8 - DNA, 4440 bp, Artificial Sequence
  Synthetic polynucleotide
atgcaaaggtcccccctggagaaggccagcgtggtgagcaagctgttcttcagctggacccgacccatcctccgcaagggctacaggcaacgtttggagctgagcgatatttaccagatcccctcagtggattcggccgacaacctgtccgagaagctggagagggagtgggatcgggagctggccagcaagaagaaccctaagctgatcaacgccctgaggcggtgcttcttctggaggttcatgttttacggcatcttcctgtatctgggcgaggtgaccaaggccgtacagcccctgctgctggggcggatcatcgccagctacgacccggataacaaagaggagaggagcatcgccatctatctgggcatcggcctgtgcctgctcttcatcgtgaggaccttgctgctgcaccccgccatcttcggcctgcaccacatcggcatgcagatgaggatcgctatgttctccctgatctacaagaagaccctgaaactgtcgagcagggtcctggacaagatatcgatcgggcagctggttagcctgctgtccaacaacctgaataagttcgacgagggcctggcgctggcccacttcgtgtggatcgcccccctgcaggtcgcgctgctgatgggcctgatctgggaactgctacaagcctccgccttctgcggcctgggctttctgatcgtgctggccctgttccaggccggcctcggccggatgatgatgaagtacagggaccagcgggccggcaagatcagcgagcggctggtcatcacgagcgagatgatcgagaacatccagagcgtgaaggcctactgctgggaggaagccatggaaaagatgatcgagaacctgcggcagacagaactgaagctgacccggaaggccgcgtatgtccggtacttcaatagcagcgccttcttcttctccggtttcttcgtggtcttcctgtccgtgctcccgtacgccctgatcaagggcatcatcctgaggaaaatcttcaccaccatcagcttctgtatcgtgctgaggatggccgtcaccaggcagtttccctgggccgtgcagacctggtacgatagcctgggcgccatcaacaagatccaagacttcctgcagaagcaggaatacaagaccctcgagtacaacctgaccaccaccgaggtggtgatggagaacgtgaccgccttctgggaggaggggttcggcgagctgtttgagaaggccaaacagaataacaacaacaggaagaccagcaacggcgatgacagcctgttcttctcgaacttcagcctgctgggcacccccgtgctgaaggatatcaacttcaagatcgagaggggccagctgctggccgtggccgggagcaccggcgccggcaagaccagcctgctgatggtgatcatgggggagctggagccgagcgagggtaagatcaagcacagcgggaggatctccttttgctcccagttctcctggatcatgccgggcacgatcaaagagaacatcatattcggggtgagctacgacgaatacaggtaccggagcgtgatcaaggcctgccagctggaggaggacatctcaaagttcgccgagaaagacaacatcgttctgggggagggcgggatcaccctgtccggcgggcaacgggccaggatcagcctggcccgcgcggtctacaaggacgccgacctgtacctgctcgatagcccgttcggttacctggatgtcctgaccgagaaggagatcttcgagagctgcgtgtgcaagctgatggccaacaagaccaggatcctggtgaccagtaaaatggagcacctgaagaaagccgacaagatcctgatcctgcacgaggggagcagctacttctacggcaccttcagcgagctgcagaacctgcagccagacttttcgagcaagctcatgggctgcgatagcttcgaccagttcagcgccgagaggaggaactccatcctgaccgaaaccctccacaggttctcactggagggcgatgcccccgtgtcctggaccgagaccaagaaacagagcttcaagcagaccggggagttcggcgaaaaacgtaagaacagcatactgaacccaataaatagcatcaggaagttctcgatcgtgcagaagacccccctccaaatgaacggcatcgaggaggacagcgacgagcccctggagcggcgcctgagcctggtgcccgacagcgaacaaggcgaggcgatcctgcccaggatcagcgtaatcagcaccggtcccaccctgcaggccaggaggcggcagagcgtgctgaacctgatgacccatagcgtgaaccagggccagaacatacaccggaagacgaccgccagcacccggaaggtcagcctggccccccaagccaacctgaccgagctggacatctacagcaggcgtctgagccaggagaccgggctggagatcagcgaagagatcaacgaggaggacctgaaggagtgcttttttgacgacatggagagcatccccgccgtgaccacctggaacacctacctgcgctacatcaccgtccacaagtccctcatattcgtcctgatctggtgcctggtcatcttcctcgcagaagtggccgccagcctggtggtgctgtggctgctgggcaacaccccgctgcaagacaagggaaacagcacccacagcaggaacaacagctacgccgtgatcatcacctccacctcgagctactacgtgttctatatctacgtgggcgtggccgacaccctgctggccatgggtttcttcaggggcctgcccctcgtgcacaccctcataactgtcagcaagatcctgcaccacaagatgctccacagcgttctgcaggcccccatgagcaccctgaacaccctgaaggccggcggcatcctgaaccggtttagcaaggacatagccatcctcgatgacctgctgcccctgaccatcttcgacttcatccagctcctgctgatcgtgatcggcgccatcgccgtggtggccgtgctccagccctacatcttcgtcgccacggtccccgtgatcgtggccttcatcatgctgcgcgcctactttctccagacaagccaacagctgaagcagctggagagcgagggacggagccccatcttcacccacctcgtgacctccctgaaaggcctgtggaccctgagggccttcggcaggcagccgtattttgaaaccctcttccacaaggccttgaacctgcatactgccaactggttcctgtacctgagcaccctgcggtggttccagatgaggatcgagatgatcttcgtgatcttcttcatcgccgtgacctttatcagcatcctgaccaccggcgagggtgagggccgggtggggatcatcctcaccctggccatgaacataatgtccaccctgcagtgggccgtgaacagcagcatcgacgtggacagcctgatgaggagcgtgtcccgggtcttcaagtttatcgacatgcccaccgagggcaagcccacgaagagcaccaagccttacaaaaacggacagctgtccaaagtgatgatcatcgagaactcccacgtcaaaaaggacgacatctggcccagcggtggccagatgaccgttaaggacctcaccgccaagtacaccgagggcggaaacgccatcctggagaacatcagcttctccatctccccgggacagcgcgtgggcctgctggggcgcaccggcagcggaaagagcaccctgctgtccgccttcctgcgcctgctgaacaccgagggggagatccagattgacggcgtgagctgggacagcatcacgctgcagcagtggcggaaggctttcggggtgatcccccagaaggtgttcatcttctccggcaccttccggaagaatctggacccctacgagcagtggagcgaccaggagatctggaaggtggccgatgaggtggggctgcggtccgtgatcgagcagttccccggcaagctggatttcgtcctggtggatgggggctgcgtgcttagccacggccacaagcagctgatgtgcctggcgaggtcagtgctgagcaaggccaaaatcctgctcctggacgagcctagcgcgcacctggaccccgtgacctaccaaatcatcaggaggaccctgaaacaagccttcgccgactgcaccgtgatcctgtgcgagcaccgcatcgaggccatgctggaatgccagcagttcctggtgatcgaggagaataaggtccggcagtacgactcaatccagaagctgctcaacgagcgtagcctgttcaggcaagccatctcgcccagcgatagggtgaagctgtttccccatcgcaacagctccaagtgtaagagcaagccccagatcgccgccctgaaggaagagaccgaggaggaggtgcaggacaccaggctt

SEQ ID NO: 9 - DNA, 4440 bp, Artificial Sequence
  Synthetic polynucleotide
atgcagaggtcccccctggagaaggccagcgtggtgagcaagctctttttcagctggacgaggcccatcctgaggaaggggtaccggcagaggctggagctcagcgacatctatcaaatccccagcgtggactccgccgacaacctgagcgagaagctcgagagggagtgggatagggagctggccagcaagaagaatccgaagctgatcaacgccctcaggcggtgcttcttttggaggttcatgttctacggcatcttcctgtacctgggcgaggtgaccaaggccgtgcagccgctgctgctgggccggatcatcgccagctacgaccccgataacaaggaggaacggtccatcgccatctacctggggatcggcctgtgcctgctgttcatcgtgagaaccctccttctgcaccccgccatcttcgggctgcaccacatcggaatgcagatgcggattgccatgttcagcctgatctataaaaaaactctgaagctcagcagcagggtgctggacaagataagcatcggccagctggtgagcctgctgagcaataacctgaacaaattcgacgagggcctggccctggcccacttcgtgtggatcgcccccctgcaagtcgccctgctgatgggcctcatctgggaactcctgcaggcctctgccttctgcgggctgggcttcctgatcgtgctggccctgtttcaagctgggctgggcaggatgatgatgaagtaccgcgaccagagggccgggaagatcagcgagcggctggtgatcaccagcgagatgatcgagaacatccagtccgtcaaggcctactgctgggaggaggccatggagaagatgattgagaatctgaggcagaccgaactgaagctcacaaggaaggccgcctacgtgaggtacttcaatagcagcgcctttttttttagcgggttcttcgtggtcttcctgagcgtgctgccctatgccctcatcaaaggaatcatcctgcgcaagatcttcaccaccatcagcttctgcatcgtcctgaggatggccgtgacgaggcagtttccctgggccgtgcagacctggtacgacagcctgggggccatcaataagatccaggacttcctgcagaagcaggagtacaagaccctggagtacaacctgacaaccaccgaggtggtcatggagaacgtgacggcattctgggaggaaggcttcggggagctcttcgagaaagcgaagcagaacaacaacaacaggaagacgagcaacggggacgacagcctgtttttcagcaatttttccctgctgggcacgcccgtgctgaaagatatcaacttcaagatcgagagggggcaactgctggccgtggccgggagcaccggcgccggcaagaccagcctgctgatggtgatcatgggcgagctcgagcccagcgaggggaagatcaagcactccgggcggatcagcttctgcagccagtttagctggataatgcccggcaccatcaaagagaacatcatcttcggggtgtcctacgacgagtaccggtaccgcagcgtgatcaaggcctgtcagctggaggaggacatctccaagtttgccgagaaggacaatatcgtgctaggcgagggcggaatcacgctgtccggcggccagcgggccaggatcagcctggccagggccgtctataaggacgccgacctgtacctgctggacagccccttcgggtacctcgacgtgctgaccgagaaggagatcttcgagtcgtgcgtgtgcaaactgatggccaacaagaccaggatcctggtgacctccaagatggagcacctgaagaaggctgacaagatcctgatcctacatgaaggctccagctacttttacgggaccttcagcgaactgcagaacctgcaacccgacttcagctccaagctgatgggatgcgactcctttgaccagttcagcgccgagaggcgcaacagcatcctgacagagaccctgcaccggttctcccttgagggcgacgcgcccgtcagctggaccgagacgaagaagcagagcttcaaacagaccggcgagttcggcgagaagaggaagaattcaatcctgaaccccatcaacagcatcaggaaattcagcatcgtccagaagacacccctgcagatgaacggcatcgaggaggacagcgatgagcccctggaaaggcgtctgagcctggtgcccgactccgagcagggcgaggccatcctccccaggatcagcgtcatcagcaccggcccgacactgcaggcccggaggagacaaagtgtgctgaacctcatgacccacagcgtgaaccagggacagaacatccataggaagaccactgcgagcacccggaaggtgtccctggccccccaggcaaacctgaccgagctggacatctactcccggcgcctgagccaggaaaccgggctggagataagcgaggagatcaatgaggaggatctgaaggagtgtttcttcgacgacatggagtcgatccccgccgtgaccacctggaacacgtatctgcgctacatcaccgtgcacaagagcctgatcttcgtgctcatctggtgcttggtgatctttctggccgaagtcgccgcctccctggtggtgctgtggctgctcggtaacacccccctgcaggacaaggggaacagcacccacagccgtaacaactcctatgccgtcataatcacctccaccagcagctactacgtcttctacatttacgtgggggtggccgacaccctgctggccatggggttcttccggggcctgccgctggtgcacaccctcattaccgtgtcgaagatcctgcaccacaagatgctgcacagcgtgctgcaggcccccatgtccaccctgaacaccctgaaggccggcgggatcctcaaccgctttagcaaggacatcgccatcctggacgacctcctgcccctgaccatcttcgacttcatccagctgctgctgatcgtgatcggcgccatcgccgtagtggcggttctccagccctacatcttcgtggccaccgtgccggtgatcgtggcctttatcatgctgagggcctacttcctgcagaccagccagcaactgaagcagctcgagagcgagggccgctcccccatcttcacccacctggtgaccagcctgaagggtctctggacgctgcgcgccttcggcaggcaaccctactttgagaccctgtttcacaaagccctgaacctgcacaccgccaactggtttctgtacctgtccaccctgaggtggttccagatgcggatcgagatgatcttcgtgatctttttcatcgccgtgaccttcatctccatcctgaccaccggggaaggggagggacgggtgggcatcatcctgaccctcgccatgaacatcatgagcaccctacagtgggccgtgaatagctccatcgacgtcgacagcctcatgcgtagcgtgagcagggtgttcaaatttatagacatgcccaccgaggggaagcccaccaagagcaccaagccctataaaaatgggcaactgtccaaagtcatgatcatagaaaacagccacgtgaagaaagacgacatctggcccagcggcggccagatgaccgtcaaggacctgaccgccaagtacaccgagggaggcaatgccatcctggagaacatcagctttagcatcagccccggccagagagtgggcctactgggccggaccggcagcggcaagtccaccctgctgagcgccttcctgcgtctgctgaataccgagggcgaaatccagatcgacggcgtgtcctgggacagcataaccctgcagcaatggcggaaggccttcggagtgatcccccagaaggtgttcatcttcagcgggacgttcaggaagaacctggacccctacgagcaatggagcgaccaggagatatggaaggtggcggacgaggtgggcctgcggagcgtcatagaacagttccccggcaagctggacttcgtgttggtcgacggcgggtgtgtcctgagccacggccacaagcagctcatgtgcctggcccgcagcgtcctgtccaaagccaaaatactgctcctggacgagccaagcgcccacctggaccccgtgacctaccagatcatccggaggaccctgaagcaggccttcgccgactgcaccgtcatcctgtgcgaacacaggatcgaagccatgctggagtgccagcagttcctggtgatcgaagagaacaaggtgcggcagtacgacagcatccagaagctgctgaatgaaagatccctgttcagacaggccatcagccccagcgacagggtcaagctgtttccccacaggaacagctccaagtgcaagtcgaagccccagatcgcggccctgaaggaggagaccgaggaagaggtgcaggacaccaggctg

SEQ ID NO: 10 - DNA, 4440 bp, Artificial Sequence
  Synthetic polynucleotide
atgcagcggagccccctcgagaaggccagcgttgtcagcaagctgtttttcagctggacccgccccatcctgagaaagggctaccgccagcggctggaactgagcgatatctaccagatccccagcgtggacagcgccgacaacctgagcgaaaaactggaaagggagtgggaccgggaactggccagcaagaagaatcccaaactgatcaacgccctccgtcgctgcttcttctggaggtttatgttctacgggatattcctatacctgggggaagtgaccaaggccgtgcagcccctcctgctgggcaggatcatcgccagctatgaccccgacaacaaggaggaaagaagcatagccatctatctagggatcgggctctgcctgctgttcatcgtcagaaccctgctgctccaccccgccatcttcggcctgcaccatatcggaatgcagatgcgcatcgcgatgttcagcctgatctacaagaaaaccctgaaactgagcagcagggttctggacaagatctccatcgggcagctggtgagcctgctgtccaacaacctgaacaaattcgacgaggggctggccctcgcacatttcgtttggatcgccccgctccaggtggccctgctgatgggcctgatatgggagctgctgcaggcctccgccttctgcggcctggggttcctcatcgtcctggccctgttccaggccgggctgggccgcatgatgatgaagtacagggaccagcgggccggcaaaatcagcgagagactggtcatcaccagcgagatgatcgagaatatccagagcgtgaaagcctactgctgggaggaggccatggagaagatgatcgagaacctgcggcagacagaactgaagctgaccaggaaggccgcctacgtgcgctacttcaattcctccgccttcttcttcagcggcttcttcgtcgtgttcctgagcgtgctgccctacgccctgatcaaggggatcatactccggaaaatcttcaccaccatctccttctgcatagttctgcgcatggccgtcaccaggcagtttccctgggccgtgcagacgtggtacgactccctgggcgccatcaacaagatccaagacttcctccagaagcaggagtacaagaccctggagtacaacctgaccaccacggaggtggtgatggagaacgtgaccgccttctgggaggagggcttcggcgagctgttcgaaaaggccaagcagaacaacaacaaccggaagaccagcaacggcgacgattccctgttcttcagcaacttcagcctgctgggcacccctgtcctcaaagacatcaacttcaagatcgagcgggggcagctcctggccgtcgccggaagcaccggcgcgggcaagaccagccttctaatggtgatcatgggtgaactggagcccagtgagggaaagataaagcacagcggccggataagcttctgctcacaattctcctggatcatgcccggcaccatcaaagagaacataatctttggtgtgtcctacgacgagtaccggtataggagcgtgataaaggcctgccagctggaggaagatatcagcaagttcgcagaaaaagacaacatcgtcctgggggagggcggtattaccctgtccggcggccaacgggcccgcatcagcttggcgagggccgtgtataaagacgccgatctgtacctgctggacagcccgttcggatacctggatgtgctgaccgagaaggagatcttcgagagctgtgtgtgcaagctgatggccaacaagacccgcatcctggtgaccagcaaaatggagcacctcaagaaagccgacaaaatcctcatcctgcacgaggggagcagctatttctacggcaccttctccgaactgcagaacctgcagcccgacttcagcagcaagctgatgggatgtgattccttcgaccagttcagcgcagaaaggaggaactccatcctgaccgagaccctgcaccgcttcagtctcgagggagatgcacccgtgagctggaccgagaccaagaagcagtccttcaagcagaccggtgaattcggcgagaagcgcaaaaattccatcctcaatcccatcaactcgatccgaaagttctccatcgtgcagaagacccccctgcagatgaatggcatcgaggaggacagcgacgagcccctggaaaggaggctgagcctggtgcccgactccgagcaaggggaggccatcctgcccaggatctccgtgatcagcaccggacccacactgcaggcccggaggaggcaaagcgtgctgaacctcatgacccactccgtgaaccagggtcagaacatccacaggaagaccaccgccagcacaaggaaagtgtccctggccccccaagccaaccttaccgagctggacatctattccaggaggctcagccaggagaccgggctagaaatcagcgaggaaatcaacgaggaggacctgaaggagtgcttcttcgacgacatggagtcaatccccgccgtgaccacctggaacacctacctgaggtacatcaccgtgcacaagagcctgatcttcgtgctgatctggtgtctggtcatcttcctggccgaggtggccgccagcctggtcgtcctctggctgctggggaacacccccctccaggataaggggaatagcacccacagccggaacaactcctacgccgtgatcatcacatccacctcctcctattatgtcttttacatctacgtcggggtggcggacacgctgctggcaatgggcttcttccggggtctgcccctggtgcataccctgatcaccgtgtccaagattctgcaccacaaaatgctgcacagcgtgcttcaggccccgatgtccacactcaacaccctcaaggccgggggcatcctgaaccggttttccaaggacatcgccatcttggacgacctgctgcccctgacgatttttgatttcatccagctgctgctgatcgtcattggcgcgatcgccgtggtcgccgtcctgcaaccctatatcttcgtggccaccgtgccggtcatcgtggcctttatcatgctgcgagcctacttcctgcagacgagccagcagctgaagcagctcgagtcagagggcaggtcccccatcttcacccacctggtgacctccctgaagggtctctggaccctgcgcgctttcgggaggcagccctacttcgagacgctgttccataaagccctgaacctgcacaccgccaattggttcctctacctctccaccctgcggtggttccagatgcgcatcgaaatgatcttcgtgattttcttcatcgccgtgacctttatctccatcctcaccaccggagaaggggaaggccgggtgggcatcatcctgacactcgccatgaacataatgagcaccctgcagtgggccgtgaacagcagcatcgacgttgacagcctgatgaggtccgtgtcccgggtcttcaagttcatcgacatgccgaccgagggcaagcccaccaaaagcaccaaaccttacaagaacgggcagctcagcaaggtgatgatcatcgagaacagccacgtgaagaaggacgacatctggcccagcggagggcagatgacagtgaaagatcttaccgccaagtacaccgaaggcggcaatgccatcctggaaaatataagcttcagcatcagccccggccagagggtcggcctgctgggcaggaccggatccgggaagagcaccctgctgtccgcctttctgcgcctgctgaacaccgagggggagatacaaatcgacggcgtgtcctgggacagcatcaccctgcagcaatggaggaaagccttcggggttatcccccagaaagtgttcattttttccgggaccttcaggaaaaacctggacccctacgagcagtggagcgaccaggaaatctggaaggtggcggacgaggtgggcctcaggagcgtgatcgagcagttccccggcaagctggacttcgtgctggtggacggcggctgcgtgctgagccacggccataagcagctgatgtgcctggccaggagcgtgctgtccaaagccaagatcctcctcctggatgagccgagcgcccatctggacccggtgacctaccagatcatccgaaggactctgaagcaggcctttgcggactgcaccgtgatcctgtgcgagcacaggatcgaggcgatgctggagtgccagcagttcctggtgatcgaagagaacaaggtgaggcaatacgactcgatccagaagctgctgaatgagaggtccctgtttaggcaggcaatcagccccagcgatagggtgaagctgttcccacaccggaactcctcgaagtgtaagtccaagccccaaatagccgccctcaaggaggagaccgaggaggaggtgcaggacacccggctg

SEQ ID NO: 11 - DNA, 4440 bp, Artificial Sequence
  Synthetic polynucleotide
atgcagcgaagccccctggagaaggcctccgtggtgtccaaactgtttttctcctggaccaggccgatcctgaggaagggctatcgtcagcgtctggagctgagcgacatctaccagatcccgagcgtcgacagcgcggacaacttaagcgagaagctggagagggagtgggatcgggaactggccagcaaaaagaaccccaagctcatcaacgccctgaggcggtgcttcttctggcgcttcatgttctacggtatcttcctctacctcggcgaggtcaccaaggccgtgcagcccctgctgctgggtaggatcatagccagctatgaccccgataataaggaggagagatccatcgccatctacctcggcatcgggctgtgcctgctgttcatcgtgcggaccctcctgctgcatcccgccatcttcggcctccaccacatcggtatgcagatgcgtatagcgatgttcagcctgatatacaaaaagaccctgaaactgagctccagggtgctggataaaatcagcatcggccagctggtgagcctgctgtccaacaatctgaacaaatttgacgagggcctggccctggcccatttcgtctggatcgcccccctgcaggtggccctcctcatgggcctgatctgggagctgctgcaggccagcgcgttttgcgggctgggcttcctgatcgtgctggccctgtttcaagcggggctgggcaggatgatgatgaagtaccgcgatcagagggccgggaagattagcgagaggctcgtgatcacgagcgagatgatcgagaacatccagagcgttaaggcctactgctgggaggaggcgatggaaaagatgatcgagaacctcaggcagaccgagctgaagctcacccggaaggccgcatatgtgaggtacttcaacagctccgcatttttcttcagcgggttcttcgtggtgttcctgagcgtgctgccctacgccctgatcaagggcatcatcctcaggaagatcttcaccaccatcagcttctgtatcgtgctgcggatggccgtgaccaggcagttcccctgggccgtgcagacctggtacgactcgctgggcgccatcaacaagatccaggatttcctccagaaacaggagtacaaaacccttgagtataacctgaccaccaccgaggtggtgatggagaatgtcacggccttctgggaagagggcttcggcgagctgttcgagaaggccaagcagaacaataacaaccggaagaccagcaacggagacgacagcctgttctttagcaacttcagcctgctcgggacccccgtgctgaaggacatcaacttcaaaatcgagaggggccagctgctggccgtcgccggatccactggagccggcaagacctccctgctgatggttatcatgggcgagctggaaccaagcgaaggtaaaatcaagcactccggccgaatctccttctgtagccagttcagctggatcatgcccggcacaatcaaggagaacattatattcggcgtgtcctacgacgagtaccgataccggagcgtgataaaagcctgtcaactggaggaggatataagcaaattcgcggagaaagacaacatcgtgctgggcgaagggggtatcaccctgtccggcggccaacgtgcgaggatcagcctggcccgggccgtgtacaaagacgccgacctatacctcctcgacagccccttcggctacctggacgtgctgacggagaaggagatcttcgagagctgcgtctgcaagctgatggccaacaaaactcggatcctggtgaccagcaagatggagcacctgaagaaggccgacaaaattctgatcctgcacgaagggtccagctacttctacgggacgttctccgagctccagaacctccagcccgacttctccagcaagctgatgggctgcgatagctttgaccagttcagcgccgagaggcgcaacagcatcctgaccgagaccctgcacaggttttcactggaaggcgacgcccccgtcagctggacggagacaaagaagcagtcattcaagcagaccggcgagtttggcgagaagaggaagaactctatcctgaaccccataaacagcatccgaaagttcagcatcgtgcagaagacccccctgcagatgaacggcatcgaggaggactccgacgagcccctcgagcggcggctgtcgctggtcccggacagcgaacagggcgaggcaatactccccaggatctccgtgatcagcaccgggcccaccctgcaggcccggcgccgacagagcgtgctgaacctgatgacccacagcgtgaaccagggccagaacattcaccggaagaccacagcctccacccgtaaggtgagcctggccccgcaggccaacctgaccgagctggacatctacagccgaaggctgtcgcaggagaccgggctggaaatctccgaggagatcaacgaggaggacctcaaggagtgtttcttcgacgatatggagagcatccccgccgtgaccacctggaacacctacctacgctatatcacagtgcataagtccctgatcttcgtgctcatctggtgcctcgtgatatttctggccgaggtcgccgccagcctggtagtgctctggctgctgggcaatacgcccctgcaggacaagggcaacagcacccattccaggaataactcgtacgccgtgatcatcaccagcacttccagctactacgtgttctatatatacgtgggggtggcggacaccctgctggccatgggcttctttcgcggtctgcccctcgtgcacaccctcatcaccgtgtccaaaatcctgcatcacaagatgctgcacagcgtgctgcaggcccccatgagcacgctcaacaccctcaaggccggcgggatcctgaataggttcagcaaggacatcgccatcctcgacgacctgctgcccctcaccatcttcgatttcatccagctcctcctgatcgtgatcggcgccatcgccgtggtggccgtcctccaaccctacatctttgtggccaccgtgcccgtgatagtcgccttcataatgctgagggcctattttctccagaccagccaacaactgaagcagctggagtcggaggggaggagccccatctttacccacctcgtgaccagcctgaaggggctgtggacgctccgggcctttggccggcagccctactttgagacgctgttccacaaggccctgaacctgcataccgccaactggttcttgtacctcagcactctccgatggttccagatgcgcatcgagatgatctttgtcatcttcttcattgccgtgacctttataagcattctgactacgggtgagggggaagggcgcgtggggatcatcctgaccctggccatgaacattatgtccaccctgcagtgggccgtgaactcctccattgacgtggacagcctgatgcggagcgtgagccgagtgttcaagttcatagatatgcccaccgagggcaagcccaccaagtccaccaagccctataagaacggccagctgagcaaggtgatgatcatcgagaacagccacgtgaagaaggacgacatatggccgagcgggggccagatgaccgtgaaggacctgaccgccaagtacaccgagggggggaatgccatcctggagaacatcagcttctccatctcccccggccaaagggtgggcctcctgggcaggaccggcagcggcaaaagcactctgctctccgccttcctgcggctgctgaacaccgagggcgagatccagatagacggcgtgagctgggactccatcaccctccaacagtggcgcaaggcgttcggcgtgatcccccagaaagtgttcattttcagcggcaccttccgcaaaaacctagatccctacgagcagtggagcgaccaggagatctggaaggtggccgacgaggtggggctgcgtagcgtgatcgagcagttccccggcaaactggacttcgtgctggtggacgggggctgcgtgctcagccacggccacaagcagctgatgtgcctggcccggtccgtgctgagcaaggccaagatcctgctgctggacgagcccagcgcccacctcgatcccgtgacctaccagatcatcaggagaaccctgaagcaggccttcgccgactgcaccgtgatcctgtgcgagcacaggatcgaggccatgctggaatgccaacagttcctggtcatcgaggagaacaaggtgcggcagtatgacagcatccagaagctcttgaacgagaggtccctcttcaggcaggcaatcagccccagcgacagggtcaagctcttcccacaccgaaactcctccaagtgcaagtccaagccccagatcgccgcgctgaaggaagagaccgaggaggaggtccaggacacccggctg

SEQ ID NO: 12 - DNA, 4440 bp, Artificial Sequence
  Synthetic polynucleotide
atgcagaggagcccgctcgagaaggccagcgtggtgtccaaactgttcttctcctggacgaggcccatcctgcgcaaggggtaccggcagaggctggagctgagcgacatataccagatcccctcagtggacagcgcggacaacctgtccgagaagctggagcgcgagtgggaccgtgagctggccagcaagaagaaccccaagctgatcaacgctctcaggagatgtttcttctggaggtttatgttctacggcatcttcctgtacctgggggaggtcaccaaggccgtgcagcccctgctcctgggccgcatcatcgccagctacgacccggataacaaggaggaaagaagcatcgcgatctacctgggcatcggcctgtgcctcctgttcatcgttcgtaccctgctgctgcatcccgccatcttcggcctacaccacataggcatgcagatgaggatcgccatgttctccctcatctacaagaaaaccctgaagttgagcagccgggtgctggacaaaatcagcatcggtcagctggtgagcctgctgagcaacaacctgaacaagttcgacgaaggcctggccctcgcccacttcgtgtggatagctcccttgcaggtcgccctgctgatgggactgatctgggagctgctgcaggcctccgccttctgcggcctgggcttcctgatcgtgctggccctgttccaagccggcctgggccgaatgatgatgaagtacagggaccaacgtgccgggaagataagcgagaggctggttatcaccagcgagatgatcgagaatattcagtccgtcaaggcctactgttgggaagaagccatggagaagatgatcgagaaccttaggcagacggagctcaagctgaccaggaaggcggcctacgtacggtatttcaacagcagcgccttctttttcagcggctttttcgtggtctttctgagcgtgctgccctacgcactgatcaaggggatcatcctcaggaagatctttaccaccatatccttctgcatcgtgctgaggatggccgtgacccggcagttcccctgggccgtccagacctggtacgatagcctgggagccatcaacaagatccaggacttcctgcagaagcaggagtacaagaccctcgagtacaacctgactaccacagaagtggtgatggaaaacgtcaccgccttttgggaagagggctttggcgagctgtttgagaaggccaagcagaataacaacaaccgtaagacaagcaacggcgacgatagcctgttcttcagcaatttctccctgctcggcacccccgtgctgaaagatatcaacttcaaaatcgagcgcgggcagctgctcgccgtggccgggtccaccggggccggcaagaccagcctgctgatggtgatcatgggcgagctggaaccctccgagggcaagatcaaacatagcggccggatcagcttctgcagccagttctcctggatcatgcccggcactatcaaggaaaacatcatcttcggcgtgagctacgacgagtacaggtatcgtagcgtcatcaaggcctgccagctcgaggaggatatctccaagttcgccgagaaggacaatatcgtcctcggcgagggcggcatcaccctgagcggcggccaacgtgcgaggatttcactggcccgggccgtgtacaaggacgcggacctgtacctcctggactccccgttcggctacctggacgtgctcaccgagaaggagatcttcgagagctgcgtgtgcaagctgatggccaacaagaccaggatcctggtgacaagcaagatggagcacctcaagaaagccgataagatcctgatcctacatgagggcagctcgtatttctacgggactttcagcgagctgcagaacctccaacccgactttagtagcaagctgatgggctgcgacagcttcgatcagttcagcgccgagaggaggaacagcatcctcacagagaccctgcaccggtttagcctggagggcgacgcgcccgtgtcctggaccgagaccaagaagcaaagcttcaagcaaaccggcgagttcggcgagaaaagaaagaacagcatcctgaaccccatcaacagcatccgcaagttctccatcgtgcagaagacccccctccagatgaacgggatcgaggaggacagcgacgagcccctggagcggcggctgagcctcgtgcccgacagcgagcagggcgaggccatcctgcccaggatatccgtgatcagcaccgggcccaccctgcaggcccggcggagacagtccgtgctgaatctgatgacccactccgtgaaccagggccagaatatccacagaaaaaccactgcctcaacgaggaaggtgagcctggccccccaggcgaacctgaccgagctggacatctacagccggaggctgagccaagagaccggcctggagatctccgaggagatcaacgaggaggatctcaaggagtgcttcttcgacgacatggagagcatccccgccgtgaccacctggaacacctacctgaggtacattaccgtgcacaagtccctgatcttcgtgctgatctggtgcctggtcatcttcctggccgaggtggccgccagcctcgtggtactgtggctgctgggcaacacccccctgcaggacaagggcaacagcacccacagtcggaacaacagctacgccgtgatcatcacctccaccagctcttactatgtgttctacatctacgtgggagttgccgacaccctgctggccatgggcttcttccgcggcctgcccctggtgcacaccctgatcaccgtgagcaagatcctccaccacaagatgctgcacagcgtgctgcaggccccaatgagcaccctgaacaccctgaaggccgggggcatcctcaacaggtttagcaaagacatcgccatcctggacgacctgctgcccctgaccatcttcgacttcatccagctcctgctgatcgtgatcggggccatcgccgtggtggccgtgctgcaaccctacatcttcgtggcgacggtgcccgtgatcgtggccttcatcatgctgcgcgcatacttcctccagaccagccagcagctgaagcagctggagagcgagggcaggtcgcccatattcacccacctggtgacctccctcaaagggctgtggaccctgagggcctttggcaggcaaccctacttcgagacgctgttccacaaggccctgaacctgcacacagccaactggttcctgtacctgagcacgctccgctggttccagatgaggatcgagatgatattcgtgattttcttcatagccgtgaccttcatcagcatcttgaccacgggcgaaggcgaaggccgagtcggtatcatcctgacgctggccatgaacatcatgagcaccctgcagtgggcggtcaatagcagcatcgacgtggactccctgatgaggagcgtgagccgcgtgtttaagtttatcgatatgccgaccgagggcaagcccaccaagtccaccaagccctacaaaaacggccagctgagtaaggttatgatcatagagaacagccacgtgaagaaggacgacatctggcccagcggcggccagatgaccgtgaaggacctgaccgccaagtataccgagggtggcaacgccatcctggagaacatctccttcagcatctctcccggccagcgggtgggcctgctcggacggaccggaagcggcaagagcaccctgctgtccgcctttctgcggctgctcaacaccgagggcgagatccaaatcgacggtgtgagctgggatagcatcacgctgcagcagtggcggaaggccttcggcgtgatcccgcaaaaggtgttcatttttagcggcacctttaggaagaatctggatccgtacgagcagtggagcgaccaggagatctggaaggtggccgacgaggtaggcctgcggagcgtcatcgaacagttccccggcaagctggacttcgtcctggtcgacggcggatgcgtgctgagccacgggcacaagcagctgatgtgcctggccaggagcgtgctgagcaaagccaaaatcctgctgctggatgagccgtccgcccacctggaccccgtgacctatcagatcatcaggaggacactgaagcaggccttcgccgactgcaccgtgatcctctgcgagcaccgcatcgaagccatgctggagtgtcagcagttcctggtgatcgaggaaaacaaggtgcggcagtacgacagcatccagaagctgctgaacgagaggagcctcttccgccaggccattagccccagcgacagggtgaaactgtttccccacaggaactcgtccaagtgcaagagcaagccccagatcgccgccctgaaggaggagaccgaggaggaggtgcaggacaccaggctg

SEQ ID NO: 13 - DNA, 4440 bp, Artificial Sequence
  Synthetic polynucleotide
atgcagcggtcacccctggaaaaggcctccgtggtgagcaagctgttcttctcctggaccaggcccatcttaagaaagggctacaggcaacggctcgagctgagcgacatctaccagatcccgtccgtggacagcgccgacaacctgagcgagaagttggaacgcgagtgggatcgcgagctcgcctccaagaaaaatcccaaacttatcaacgcgctgaggagatgcttcttctggaggttcatgttctacggcatcttcctgtacctgggagaggtgaccaaggccgtgcagcccctcctgctcggccgcataatagccagctacgaccccgacaataaggaggagcgtagcatcgccatctacctgggtatcgggctgtgcctgctgtttatcgtgcgcaccctcctgctgcatcccgccatcttcggcctgcaccacatcggcatgcagatgcgaatcgccatgttttcgctgatctacaaaaaaaccctgaagctgtcaagcagggtgctggataagatcagcatcggccagctggtgtcactgctgagcaacaatctgaacaagttcgacgagggcctggccctggcccatttcgtgtggatcgcccccctccaggtggcgctgctgatgggcctcatctgggagctgctgcaggcgtccgccttctgcggtctgggcttcctgatcgtgctggccctctttcaggccgggctcggtaggatgatgatgaaatacagggaccagagagccggcaagatttcagaaaggctggtgatcaccagcgaaatgatcgagaacatccaatccgtgaaggcctattgctgggaggaagccatggagaagatgatcgagaacctgcgacagaccgaactcaagctcacccggaaggccgcctacgtgaggtacttcaactcctccgccttcttctttagcggcttcttcgtggtctttctgagcgtgctgccctacgccctcatcaagggcatcatcctgaggaagatctttaccaccatctccttctgtatcgtcctccgaatggccgtgacgcgtcagttcccctgggctgtccagacttggtatgacagcctaggggccatcaacaagatccaggatttcctgcaaaaacaggagtacaagaccctagagtacaatctcaccaccacggaggtcgtgatggagaacgtgacggccttctgggaggagggcttcggggagctctttgaaaaggccaagcagaataacaacaataggaagacgagcaatggcgacgacagcctcttcttcagcaacttcagcctgctggggacgcccgtgctcaaagacatcaacttcaagatcgagcgggggcagctgctggccgtggccggaagcacgggagccggcaagaccagcctgctgatggtgatcatgggggagctcgaaccctccgaaggcaagatcaagcatagcgggaggatcagcttctgcagccagttctcctggataatgccagggaccatcaaggagaacatcatctttggcgtgagctacgacgagtacaggtatcggtctgtcatcaaagcctgccagctggaagaggatatcagcaagtttgcagagaaggacaacatcgtgctgggggaaggcggcatcaccctgagcggcgggcagcgcgccaggatctccctggcccgtgcggtgtacaaggacgccgacctgtacttactggacagccccttcggctatctggacgtgctaaccgagaaggaaatcttcgagtcctgcgtgtgtaagctgatggccaacaagacccgcatcctggtgacctccaagatggagcacctcaagaaggccgataagatcctgatcctgcacgagggctccagctacttctacggcaccttcagcgagctgcaaaacctccaacccgacttctctagcaagctcatggggtgcgactcgttcgaccagttcagcgccgaaaggcggaacagcatcctgactgagaccctgcacaggttcagcctggagggggatgcccccgtgagctggactgaaaccaagaagcagtccttcaagcagaccggcgagtttggcgagaagaggaagaacagcatcctgaaccccatcaactcgatccgcaagttcagcatagtgcagaaaacccccctgcaaatgaacggcatcgaggaggactccgacgaacccctcgagaggaggctgagcctcgtgccggacagcgagcagggggaggcgattctcccccgcatctccgtcatcagcacgggtcccaccctgcaagccaggcgtcggcaatccgtgctgaacttgatgacccactccgtgaaccagggccagaacatccataggaaaaccaccgccagcacccggaaggtgtcactggccccccaggcgaaccttacggagctggacatctacagccgacggcttagccaagagaccggcctggagatcagcgaagagatcaacgaggaggatctgaaagagtgcttctttgatgacatggaaagcatccccgccgtgactacctggaatacctatctgcgttatatcaccgtccacaaatccctgatcttcgtgctgatctggtgcctggtgatctttctggctgaagtggccgcctccctggtggtgctgtggctcctgggcaacacccccctgcaggacaaaggcaacagcacgcacagccggaacaactcctacgccgtgatcatcacctccaccagctcctactacgtcttctacatctacgtgggggtcgccgacaccctgctggccatgggctttttcaggggcctgccactggtccacaccctgatcaccgtgagcaaaatcctgcatcacaagatgctccactccgtgctgcaggcccccatgagcaccctgaataccctgaaggccggcggcatcctgaaccgctttagcaaggacatcgccatcctggacgacctgctgcccctgaccatttttgactttatccagctgctgctgatcgtgataggcgccatcgccgtggtggccgtcctgcagccctatatcttcgtggcaacggtcccggtgatcgtcgccttcatcatgcttagagcctatttcctgcagacgtcccagcaactgaagcagctggagagcgagggcaggagcccgatctttacccacctcgtgaccagtctgaagggcctgtggaccctgcgggccttcggacggcaaccctacttcgagaccctgttccacaaggccctgaacctgcacacagccaactggttcctgtacctgagcaccctgaggtggttccagatgaggatcgagatgatctttgtgatcttcttcatcgccgtgaccttcattagcatcctgacgaccggagagggcgagggccgcgtcggcatcatcctgaccctggccatgaatatcatgagcaccctgcagtgggccgtgaatagctccatcgacgtggacagcctcatgcgaagcgtgagcagggtgttcaagtttatagacatgcccaccgagggcaagcccaccaagagcaccaaaccctacaagaacgggcagctctccaaggttatgatcatcgagaatagccatgtgaagaaggacgatatctggccgtccggcggccagatgaccgtgaaggacctcaccgcaaagtacaccgagggcgggaacgcaatcctcgagaacatcagcttcagcatctcccccgggcagcgggtgggcttgcttgggcgcacaggcagcggaaagagcaccctgctgagcgccttcttgcgactgctcaacaccgagggggagatccagatcgacggcgtctcatgggactccatcacgctgcagcagtggcggaaggccttcggggtgatcccccagaaggtcttcatcttttccggcaccttccggaagaacctggacccctacgagcagtggtccgaccaagagatttggaaggttgccgacgaggtgggcctgaggagcgtgatcgagcagttccccggcaagctcgacttcgtcctggtggacgggggctgcgtgctgagccacgggcacaagcagctgatgtgcctggccaggagcgtcctgagcaaagccaagatcctcctgcttgacgagcccagcgcccacctggacccggtgacgtaccagatcatccgcaggacgctgaaacaggcattcgccgactgcaccgtgatcctctgcgagcataggatcgaggccatgctggagtgccagcagttcctcgtcatcgaggagaataaggtgcggcagtacgattccatccagaagctgctgaacgagaggagcctgttccggcaagccatctcgcccagcgaccgggtgaagctgttcccccatcgtaacagcagcaaatgcaagagcaagccccagattgccgccctgaaggaagagaccgaggaggaggtgcaagacacgcgcctg

SEQ ID NO: 14 - DNA, 4440 bp, Artificial Sequence
  Synthetic polynucleotide
atgcagcgcagccccttagaaaaggccagcgttgtgtccaagctgttcttctcctggacccggcccatcctgcgcaagggctataggcagaggctggagctgagcgatatctaccagataccctccgtggacagcgccgacaacctgtcggagaaactcgagcgggagtgggacagggaactggccagcaagaagaacccgaagctgatcaacgccctccgacggtgtttcttctggaggttcatgttctacggcatcttcctgtatctgggggaagtgaccaaggccgtgcagcccctgctcctgggccggattatcgccagctatgaccccgacaacaaggaggagcgatcgattgccatctacctcggcatcggcctgtgcctgctgttcatcgtaaggaccctcctgctacacccggccatcttcggcctgcaccacatcggcatgcagatgcggatagccatgttctccctgatctacaagaagacgctgaagcttagcagccgggtgctggacaagatcagcataggccagctggtgagcctgctgagcaacaatctgaataagttcgacgagggactggccctcgcgcatttcgtgtggatcgcccccctgcaggtggctctgctgatgggcctgatctgggagctgctccaggccagcgccttctgcggcctcggcttcctcatcgtgctggccctgtttcaagccggcctcggccggatgatgatgaagtacagggatcagcgggccggaaagatctccgagaggctggtgattacctccgagatgatcgagaacatccagtccgtgaaagcctactgctgggaagaggcaatggagaagatgatcgagaatctccgccagaccgagctgaagctgacacgtaaggccgcctatgtcaggtacttcaacagcagcgccttcttcttctccggctttttcgtggtgttcctgagcgtgctgccgtatgccctgatcaagggcatcatcctgaggaaaatcttcacgacgatcagcttttgcattgtgctgcggatggccgtcaccaggcagttcccctgggccgtgcagacctggtacgactccctgggggccatcaacaagatccaagatttcctccagaagcaggagtacaagacgctggagtataatctgaccaccaccgaagtggtgatggagaacgtgacagccttctgggaggagggctttggagagctctttgagaaggccaagcagaacaacaacaaccggaagaccagcaacggcgacgactctctgttttttagcaactttagcctgctggggacccccgtgctgaaggacatcaacttcaagatcgagaggggccagctcctggcggtggccggcagcaccggagccggcaaaacctccctcctgatggtcatcatgggcgaactggaacccagcgagggcaaaatcaagcactccggccgaatctccttctgctcccagttctcctggataatgcccggtacaataaaggagaacatcatctttggggtgagctacgacgagtaccgctacaggtcggtgataaaggcctgccagctggaggaggacatcagcaagttcgccgaaaaggacaacatcgtgctgggggagggtggcataaccctcagcggcgggcagagggcgaggatcagcctggccagggccgtgtacaaggacgccgacctgtacctgctggactcccccttcggctacctagatgtgttaacggagaaggagatcttcgagtcctgtgtgtgcaagctgatggccaacaagacccgcatcctcgtgaccagcaaaatggaacacctcaagaaggcagacaagatcctgatcctgcacgagggttccagctacttctacggcacgttcagcgagctgcagaatctgcagcccgacttctcgtcgaagctcatgggttgtgatagcttcgatcagttcagcgcggagcgaaggaactccatcctgaccgagaccctgcacaggttctccctggaaggggacgcccccgtgagctggaccgagaccaagaagcaaagcttcaagcagaccggagagtttggggagaagcgcaagaatagcatcctgaatcccatcaacagcatccggaagttctccatcgtgcagaaaacccccctgcagatgaacggcatcgaggaggatagcgacgagccccttgagaggcggctgagcctggtgcccgacagcgagcagggggaggccatcctgccccggatctccgttatctccaccggcccgaccctgcaggccaggaggcgccaaagcgtgctgaatctgatgactcactccgtaaaccagggccagaacattcacaggaagaccaccgccagcacccgaaaggtgagcctggccccccaggccaacctgaccgagctggacatctacagccggcgcctgagccaggagacaggactggagatcagcgaagagatcaacgaagaggacctcaaggagtgcttcttcgacgacatggagagcatccccgccgtaaccacctggaacacctatctgaggtacatcacggtgcacaagagcctcatcttcgtgctcatctggtgtctggtcatcttcctggcagaggtcgccgcgagcctggtggtcctgtggctgctgggcaacacccccctgcaggacaagggaaacagcacccattcccggaacaatagctacgccgtcatcatcaccagcacctccagctattacgtgttctatatctacgtcggggtggcggacaccctcctggcgatgggcttcttcaggggcctgcccctggtgcacaccctgatcaccgtgagcaagatcctgcaccacaagatgctgcactccgtgctgcaggcccccatgagcaccctcaatacgttgaaagcgggcggaatcctgaacaggttctccaaagacatcgccatcctggacgacctgctgccgctgaccatcttcgatttcatccagctgctgctgatcgtgataggagccatcgccgtcgtagccgtcctgcagccctacatcttcgtggcgaccgtcccggtgatcgtggcgttcatcatgctgcgggcctacttcctgcagaccagccagcagctgaagcagctggaaagcgagggccgatcccccatcttcacgcacctggtcacctccctgaagggcctgtggaccctgcgggcattcggcaggcagccgtacttcgagaccctcttccacaaagccctgaacctgcacacagccaactggttcctctacctcagcaccctccggtggtttcaaatgagaatcgagatgatctttgtgatattcttcatcgccgtgacgttcatcagcatcctgacaaccggcgagggagagggtagggtgggcatcatcctgaccctcgccatgaacatcatgagcacactgcaatgggcggtgaacagcagcatcgacgtggactccctgatgcggtccgtcagcagggtgttcaaattcatcgacatgccaaccgagggcaagccaaccaagagcaccaagccgtacaagaatggccaactcagcaaggtgatgatcatcgaaaacagccacgtgaaaaaggacgacatctggccctccggcgggcagatgaccgtgaaggacctgaccgcgaagtacaccgaggggggaaacgccatcctggagaatatctccttcagtatcagcccgggccagagggtcggactcctgggcaggaccggcagcggcaagtccaccctgctgtcagccttcctgcgcctgctgaacacggagggcgagatccagatagacggggtgtcatgggatagcatcaccctgcagcagtggaggaaggccttcggggtcatcccccagaaggtgttcatcttctccggtaccttcaggaagaacctggacccgtacgagcaatggtccgaccaggagatctggaaggttgccgacgaggtcggcctgaggtccgtgatcgagcagttccccggcaagctcgactttgtgctggtggatgggggctgcgtgctcagccacggccacaagcagctgatgtgcctcgccaggagcgtgctgtccaaagccaagatcctgctgctggacgagcccagcgcccatctggatcccgttacctatcagatcatccggcggacgctgaagcaggccttcgccgactgtacagtgatcctgtgcgagcacagaatcgaggccatgctggagtgccagcagttcctggtgattgaagagaacaaggtgcggcagtacgacagcatacagaagctgctgaacgaaaggtccctgtttaggcaagccatcagccccagcgacagggtgaagctgtttccccaccgaaacagcagcaaatgcaagtccaagccccagatcgccgcgctgaaagaggaaacagaggaggaggtacaggacacacggcta

SEQ ID NO: 15 - DNA, 4440 bp, Artificial Sequence
  Synthetic polynucleotide
atgcagcgcagcccgctcgaaaaggccagcgtcgtgtcgaagctgttctttagctggacccgacccatcctgagaaagggctatcgtcagaggctggagctgtcggacatctaccagatcccctccgtggacagcgccgacaatctctccgaaaaactggagcgtgagtgggatcgcgagctggcctccaagaagaaccccaagctgatcaacgccctgaggaggtgtttcttctggaggttcatgttctatggcatattcctgtacctgggcgaggtgaccaaggccgtccagcccctgctcctcggcaggatcatcgcaagctacgatcctgacaacaaggaggaaaggagcatcgccatctacctgggcataggcctgtgcctgctgttcatcgtgcgcaccctgctgctgcaccccgccatattcgggctgcaccacatcgggatgcagatgcgcatcgccatgttcagcctgatctacaagaagactctgaagctgtccagtcgggtgctggacaaaatctccataggacagctggtgtcgctgctgagcaacaacctgaataagtttgacgaggggctggccctggcccatttcgtgtggatcgcccccctgcaagtcgccctgctgatgggcctgatctgggagctcctgcaggccagcgccttttgcggcctggggttcctcatcgtcctggccctgttccaggcaggcctgggccggatgatgatgaaatacagggaccagagggcgggcaagatcagcgagaggctggtgatcacctccgagatgatcgagaacatccagtcggtgaaggcttactgctgggaggaggccatggagaagatgatcgaaaacctcaggcagacggagctgaagctgaccaggaaggccgcctacgtgaggtacttcaactcatccgccttctttttctccggattcttcgtggtgttcctgtccgtgctgccctatgccctgatcaagggcatcatcctccggaagatcttcacaaccatctccttctgcattgtactgaggatggccgtgactaggcagttcccctgggccgtccagacctggtacgacagcctgggcgcaatcaacaagatccaggactttctgcagaagcaagagtataagaccctggagtacaacctgacgactacggaggtggtcatggaaaacgtgaccgcattctgggaggagggtttcggggaactgttcgagaaggccaagcagaacaataacaacaggaagacgagcaatggcgatgatagcctgttcttcagcaacttcagcctcctggggacccccgtgctgaaggacatcaactttaagatcgagcgaggccagctgctggccgtggccggctccaccggagccggcaagacatcattgctgatggtgatcatgggcgaactcgaacccagcgaggggaagatcaagcactccgggaggatctccttctgcagccaattcagctggatcatgccgggcaccatcaaagagaacatcatctttggcgtgtcctacgacgagtaccggtatcgtagcgtcatcaaggcctgtcagctggaggaggacatctccaagttcgccgagaaggacaatatagtgctgggcgagggcggtatcaccctgagcgggggccagagggccaggatctccctggcccgggccgtgtacaaagacgccgatctgtacctgctggacagccccttcggctacctggacgtgctgaccgagaaggagatctttgaaagctgcgtatgcaaactgatggccaacaaaacccgtatcctggtgaccagcaagatggagcacctcaagaaggccgataagatcctgatcctgcatgagggcagctcctatttctacggcacctttagcgagctgcagaacctgcagcccgatttcagcagcaagctgatgggctgcgacagcttcgaccagttcagcgccgaaaggaggaactccatcctcacggagaccctgcacaggttcagcctggagggcgatgcgccggtctcctggaccgaaacgaaaaagcagtccttcaagcagaccggcgagttcggagaaaaacgaaagaattccatcctgaaccccataaactccatccggaaattctccatcgtgcagaagaccccgctgcagatgaacgggatcgaggaggacagcgacgagcccctggagcgaaggctgtccctggtgcccgatagcgaacagggcgaagccatcctgcccaggatcagcgtgatcagcaccggccccacgctgcaagcgcgcaggcgtcaaagcgtcctgaacctgatgacccacagcgtgaaccagggccaaaacatccaccgcaaaaccactgccagcacccggaaggtgagcctggccccgcaggcaaatctgaccgaactggacatctacagccgcaggctgagccaggaaacgggtctcgagatcagcgaggagatcaacgaggaggacctgaaagaatgctttttcgacgacatggagtccattcccgccgtgaccacctggaacacctacctgaggtatatcaccgtgcacaagagcctgatcttcgtgctgatctggtgcctggtgatctttctggccgaagtggctgccagcctggtggtgctgtggctcctgggcaatacccccctgcaagacaagggcaactccacccactcccggaacaacagctacgccgtgatcatcaccagcaccagcagttactatgtgttctacatctacgtcggggtggcggacacactgctcgcaatgggattcttccgcgggctgccgctggtgcacaccctgatcaccgtcagcaagatcctgcatcacaagatgctgcacagcgtcctgcaggcccccatgtccaccctcaacaccctgaaggccggggggatcctgaaccggttctccaaggacatcgccatcctggacgacctgctgcccctgaccatcttcgatttcatccagctgctgctgatcgtgatcggggccatcgccgtggtggcggtgctgcagccctacatctttgttgccaccgtgccggtcattgtggcctttatcatgctccgggcctacttcctgcaaaccagccagcagctgaagcaactagaatccgaagggaggagccccatcttcacccatctggtgacctccctcaaggggctgtggaccctgagggccttcggcagacagccctacttcgagaccctgttccacaaagccctgaatctgcacaccgccaactggttcctctacctgtcaaccctgaggtggttccagatgcgcatagaaatgatatttgtgatattcttcatcgccgtgacgttcatcagcatactgaccaccggggagggagaggggcgtgtgggcatcatcctgaccctcgcgatgaacattatgagcaccctgcagtgggccgtgaacagctccatcgacgtggacagcctgatgcgctccgtgagcagggtgtttaagttcatcgacatgcccaccgagggcaagcccaccaagagcaccaagccctataagaacggccagctctccaaggtgatgatcatcgagaactcccacgtgaagaaagacgatatctggcccagcggcggccagatgaccgtgaaggatctgaccgccaagtacaccgagggagggaacgccatcctcgagaacatctccttcagcatcagccccggccagagggtgggcctgctgggccggaccgggtccggcaagtcaacgctgctgagcgccttcctgagactcctcaacaccgagggcgagatacagatcgacggggtgagctgggactccatcaccctgcaacagtggcgtaaagctttcggggtcatcccccagaaggtgttcatcttcagcggcacattccggaagaacctggacccctatgagcagtggtccgaccaggagatctggaaggtggccgatgaggttggcctgaggtccgtgatcgagcaattccccggcaagttagactttgtgctggtggacgggggctgcgtgctcagccacgggcacaagcagctgatgtgcctggccaggagcgtgttgagcaaggccaagatcctccttctggacgagccctccgcccacctggacccagtcacctaccagatcatcaggcgaaccctgaagcaggccttcgccgactgcaccgtgatcctgtgtgagcaccggatcgaggccatgctggagtgccagcagttcctggtgatcgaggagaacaaggtgcggcagtacgacagcatccagaagctcctgaacgagaggagcctgttccgccaggccatcagccccagcgaccgggtcaagctgttcccccaccgcaactccagcaagtgcaagagcaaaccccagatcgccgcactgaaggaggagacggaggaggaggtgcaagacacccgcctg

SEQ ID NO: 16 - DNA, 4440 bp, Artificial Sequence
  Synthetic polynucleotide
atgcagcggagccccctggagaaggctagcgtcgtgtccaagctgttctttagctggacccgacccatcctccgcaaagggtataggcagaggctcgagctgtccgatatctaccagatcccctccgtggacagcgccgataacctctctgagaagctggagcgggagtgggaccgcgagctggccagcaagaagaatcccaagctcatcaacgcactgaggcggtgcttcttttggcggttcatgttctatggcatctttctgtacctgggggaggtcaccaaggccgtgcaacccctcctcctcggcaggatcatcgcctcctatgaccccgacaacaaagaggagaggtccatagccatctacctgggtatcggcctgtgcctgctgttcatcgtgcgtaccctgctgctgcaccctgcgatattcgggctgcaccacatcggaatgcagatgaggatcgcgatgttctccctcatctataagaagaccctgaagctgagcagcagggtgctcgacaagatcagcatcggacagctggtgtcgctgctgtccaacaacctaaacaagttcgatgaggggctggccctcgcccatttcgtgtggatcgcccccctgcaagtggccttgctaatgggcctcatctgggagctgctgcaggcctccgccttctgcggcctgggattcctgatcgtcctggccctgttccaggccgggctgggccgcatgatgatgaagtacagggatcagcgggccggaaagatcagcgagcgcctcgtgatcacctccgagatgatcgagaacatccagtccgtgaaggcctactgctgggaggaggccatggagaagatgatagaaaatctcaggcagaccgagctgaagctgactaggaaggcggcctacgtgaggtactttaacagctccgccttcttcttcagcggcttttttgtggtgttcctctcggtgctgccctacgccctgatcaagggcatcattctgcgcaagatcttcaccaccatctcattctgcatagtgctgaggatggccgtgacccgacagttcccttgggctgtgcagacctggtatgacagcctcggggccatcaacaagatccaggactttctgcagaagcaggagtataagaccctcgagtacaacctgaccaccaccgaggtggtcatggagaacgtcaccgccttctgggaggaaggcttcggagagctgttcgagaaagccaaacagaacaacaacaacaggaagacctccaacggcgatgattcgctgttcttcagcaatttcagcctcctgggcacccccgtgctcaaggacatcaacttcaaaatcgagagggggcagctgctggccgtggcgggtagcaccggcgccggcaagacaagcctgctcatggtcatcatgggcgagctggagcccagcgaggggaaaatcaagcacagcgggcggatcagcttctgctcacagttcagttggatcatgcccgggaccatcaaggagaacatcatatttggggtgagctacgacgagtaccggtacaggtccgtgatcaaggcgtgccaactggaagaggacatcagcaagttcgccgagaaggacaacatcgtgctgggagagggtggaatcaccctgagcggtgggcagcgggccaggataagcctcgccagggccgtgtacaaagatgccgacctgtacctgctggactccccgttcggctatctggacgtgctgaccgaaaaggagatcttcgagtcctgcgtgtgtaagctcatggcgaacaagacccggatcctggtcacctccaagatggagcacctgaagaaggcggacaagatactcatactgcacgaggggagctcatacttctacggaacctttagcgagctgcagaacctccagcccgacttcagctccaagctgatgggttgcgacagcttcgaccagttcagcgccgagaggcggaacagcatactgaccgagaccctgcataggttctccctcgagggggacgccccggtgtcctggacggagaccaaaaaacagagcttcaagcagacgggggaattcggcgagaagcggaaaaacagcatcctcaaccccatcaacagcatccggaagtttagcatcgtccagaagacgcccctgcagatgaacggcatcgaggaggacagcgatgagcccctcgagaggaggctgagcctggtgcccgacagcgagcagggcgaggccatcctgccacggatcagcgtgatcagcaccgggcccacgctgcaggcccggaggcggcagtccgtgctgaacctcatgactcacagcgtgaaccagggacagaacatccacaggaaaacaacggcctccacccgcaaggtctccctggccccccaagccaacctgaccgagctggacatctactcgaggaggctgagccaggagaccggcctggagatcagcgaggagatcaacgaagaggacctgaaggagtgcttctttgacgatatggagtccatccccgcggtgacgacgtggaatacctaccttaggtacatcaccgtgcataagagcctgatcttcgtgctgatctggtgcctggtgatcttcctggccgaggtggccgcatccctggtggtgctgtggctcctgggcaatacccccctgcaggacaaaggcaacagcactcatagcaggaataactcctacgccgtgataatcacaagcaccagcagctactacgtgttctacatatatgtgggcgtggccgataccctgctggccatgggcttcttcagggggctgcccctggtgcacaccctgatcacggtgagcaagatcctgcaccacaagatgctccacagcgtactgcaggcccccatgtcgactctgaacaccctgaaggccggcgggatactgaacaggttcagcaaggacatcgccatcctggacgacctgctgcccctcacgatcttcgacttcatccagctgctgctgatcgtgatcggggccatcgccgtggtggccgtgctgcagccctacatcttcgtcgccaccgtgcccgtgatcgtggccttcatcatgctgagggcctacttcctccagaccagccagcagctgaagcagctggagagcgaggggaggagccccatcttcacccatctggtgacctccctgaaggggctgtggactctccgcgccttcggcaggcagccgtacttcgagacgctgttccacaaggccctgaacctccacaccgccaactggttcctttatctgagcacccttcggtggttccagatgcgtatcgagatgatcttcgtgatcttctttatcgccgtgacctttatcagcattctgaccaccggagagggggaggggcgggtggggatcatcctgacgctggccatgaatatcatgtccaccctgcaatgggccgtgaactcctccatcgacgtggatagcctgatgcgatccgtcagcagggtgtttaagttcatcgacatgcccaccgagggcaagccgaccaagtcgaccaagccgtacaagaacggtcagctgtccaaggtcatgatcatagaaaactcccacgtgaagaaggatgacatctggccctccggcggccagatgaccgtgaaggacctgaccgccaagtacaccgagggcgggaacgctatcctggagaacatctccttcagcatctcccccggccagagggtgggcttgctcgggaggaccggcagcggtaagagcaccctgctgtccgccttcctgaggctgctgaacaccgagggcgaaatccagatagatggcgtgagctgggactccatcaccctccagcagtggaggaaggccttcggcgtgatcccccagaaggtctttattttcagcggcacctttaggaaaaatctcgacccgtatgaacagtggagcgaccaagaaatctggaaggtggcagacgaggtgggcctgagatccgtgatcgagcaattccccggcaagctggatttcgtgctggtcgacggcggctgcgtgctcagccacgggcacaagcagctgatgtgcctggccaggtccgtcctcagcaaggccaagatcctgctgctggacgagccctccgcccatctggaccccgtgacctaccagatcatcaggcggaccctcaagcaagccttcgccgactgcaccgttatactgtgcgagcacaggatcgaggccatgctggagtgccaacagttcctggtcatcgaagagaataaggtgaggcagtacgatagcatccagaagctgctgaacgagcggagcctgtttcgtcaagccatcagccccagcgacagggtgaagctgttcccccaccgcaactcctcaaaatgcaagagcaagccccagatcgccgccctcaaggaggaaaccgaggaggaggtccaggacacccggctg

SEQ ID NO: 17 - DNA, 4440 bp, Artificial Sequence
  Synthetic polynucleotide
atgcaacggtcgcccctggagaaggcctcggtggtgagcaaactgttcttcagctggaccaggcccatcctgcggaagggctataggcagcggctcgagctcagcgacatctatcagatcccctcggtcgactccgccgacaacctgtccgagaaactggagcgcgagtgggacagggaactggccagcaagaagaatccgaaactgatcaacgccctcaggcgctgcttcttttggaggttcatgttctacggcatattcctgtacctgggcgaggtgaccaaggccgtgcagcccctcctgctgggacgaatcatcgcctcctacgaccccgataacaaggaggagcgcagcatcgccatctacctgggcatcggcctgtgcctgctgttcatcgtgcggaccttactgctgcacccggccatcttcgggctgcaccacatcggcatgcagatgaggatcgcaatgttcagcctgatctacaagaagaccctgaagctctctagccgcgtgctcgacaagatcagcataggccaactggtgagcctgctgagcaacaacttgaacaagttcgatgagggcctggccctggcccacttcgtttggatcgccccccttcaagtggcgctgcttatgggcctgatctgggagctgctgcaggccagcgccttctgcggcctcgggttcctgatagtgctggccctgttccaggcggggctcggcaggatgatgatgaagtacagggaccagcgcgccgggaagatcagcgagcggctggtgatcacctccgaaatgatcgagaacatccagagcgtgaaggcctactgctgggaggaggccatggagaagatgatagaaaacctgaggcagaccgagctcaagctgaccaggaaggccgcctacgtgcggtactttaacagcagcgccttcttctttagcggctttttcgtggtgttcctgagcgtgctgccctacgccctgatcaagggcatcatcctcaggaaaatcttcaccaccatcagcttttgcatcgtgctccgaatggccgtgacccggcagttcccctgggccgtccaaacctggtacgacagcctgggcgccataaataagatacaggacttcctgcagaagcaggagtacaagaccctggagtacaacctgaccaccaccgaggtggtgatggagaacgtgaccgccttctgggaggaagggttcggcgagctgttcgagaaagccaaacaaaataacaacaatcgaaagacctccaacggcgacgacagcctgttcttcagcaattttagcctgctgggcacccccgtgctgaaggacatcaatttcaagatcgaaaggggccaactgctggccgtggccgggagcaccggggcgggaaagacctcccttctgatggtgatcatgggcgagctcgagcccagcgaggggaagatcaagcacagtggaaggataagcttctgcagccaattcagctggatcatgccggggaccatcaaggagaacatcatcttcggcgtaagctacgatgagtaccgttaccggagcgtgatcaaggcctgccagctggaggaggacatcagcaagtttgccgagaaggataacatcgtgctgggcgagggcggcatcaccctgagtggcggccagagggccaggatcagcctggccagggccgtgtataaggatgccgacctctacctgctggactcccccttcggatacctggacgtgctgaccgaaaaagagatcttcgagagctgcgtgtgcaagctcatggccaacaagaccaggatcctcgtcaccagcaaaatggagcacctgaagaaggccgataagatactgatcctgcacgaggggagctcctacttctacggcaccttcagcgaactgcagaacctgcagcccgacttctccagcaagctcatggggtgcgacagctttgaccagttcagcgcggaacgtcggaactccatcctgaccgagaccctgcataggttcagcctggagggggacgccccggtcagctggaccgagacaaagaagcagtcctttaagcagaccggcgagttcggagagaaacgcaaaaacagcatcctgaaccccatcaatagcatcaggaagtttagcatcgtgcagaagacccccctgcagatgaacggcattgaggaggacagcgacgaacccctggagcgcaggctgagcctggtgcccgacagcgaacagggcgaggccatcctgccccggatcagcgtcatcagcaccggccctaccctgcaggccaggcgtaggcagagcgtgctgaacctcatgacccattccgtgaatcaaggtcagaacatccaccgcaagaccaccgccagcaccaggaaggtctccctggccccccaggccaatctcaccgagctggatatctacagcaggcgcctgagccaggagaccggcctggagatcagcgaggagatcaacgaggaggacctgaaggagtgcttcttcgacgacatggagagcatacccgccgtgaccacctggaacacgtacctccggtatatcaccgtccacaaatccctgatcttcgtgctgatctggtgcctggtgatcttcctggccgaggtggccgccagcctggtggtgctctggctgttgggcaacacacccctgcaggacaagggcaacagcacgcattcccggaacaatagctacgccgtgatcatcacgtcgaccagctcgtactacgtgttctacatctacgtgggcgtggcggacacgctgctggccatgggcttctttcgcgggctgcccctggtgcacaccctgataaccgtgagcaagatcctgcaccataagatgctccacagcgtcctccaggcccccatgagcaccctgaacacgctgaaggccggcgggatcctgaacaggttctctaaggacatcgccatcctcgacgacctgctgcccctgactatcttcgacttcatccagctgctgctcatcgtgatcggcgccatcgccgtggtggccgtgctgcagccctacatcttcgtcgcaaccgtgccagtgatcgtggccttcatcatgttgagggcctacttcctgcagaccagccagcagctgaagcaactggagtcggagggaaggagccccatcttcacccatctggtcaccagcctgaaaggcctgtggaccctgagggcctttggccggcagccctacttcgagaccctgttccacaaggccctgaacctgcataccgccaactggttcctgtacctgtccaccctgcggtggttccaaatgaggatcgagatgatcttcgtgatcttcttcatcgccgtgaccttcatctccatccttaccacaggcgagggcgagggcagggtaggcataatcctgaccctggccatgaacatcatgtccacgctgcagtgggccgtcaacagcagcatcgacgtggacagcctcatgaggtccgtgtccagggtcttcaaattcatcgacatgcccaccgaggggaagcccaccaaaagcaccaagccctacaagaatggacagctgagcaaggtgatgatcatcgagaacagccatgtgaagaaagacgatatctggccgagtgggggccagatgacggtgaaggacctgaccgccaagtacaccgagggcggcaacgcgatcctggagaacattagcttcagcatctctcccggacagcgggtcgggctgctcggccgaaccggaagcgggaagtccacactgctgtccgcgttcctgcgtctgctgaataccgagggggagatccaaatcgacggcgtgagctgggacagcatcaccctgcagcagtggcggaaggccttcggcgtcatcccccagaaggtgttcatctttagcgggacctttaggaagaacctggatccctatgagcagtggagcgaccaagagatctggaaggtggccgatgaggtaggcctgagaagcgttatcgagcagttccccggcaagctggacttcgtcctggtcgacggcggctgtgtgctcagccacggccataaacagctgatgtgcctggcccgaagcgtgctgagcaaggcgaaaatcctcctgctggacgagccctcggcccacctggaccccgtgacttaccagatcattcgacgtaccctgaagcaggcctttgccgattgtaccgtcatactgtgcgagcacaggatcgaggccatgctggagtgccaacagttcctggtgatcgaggaaaacaaggtacgccagtacgacagcatccagaagctcctgaacgagcggtccctctttaggcaggccatcagcccctccgaccgtgtgaagctgttcccccacaggaacagcagcaagtgtaagagcaagccccagatagccgccctgaaggaggagaccgaggaggaagtgcaggacacccggctg

SEQ ID NO: 18 - DNA, 4440 bp, Artificial Sequence
  Synthetic polynucleotide
atgcagaggagccccctggagaaggccagcgtggtgtccaagcttttcttttcctggacccgcccgatcctgcgaaaggggtataggcagcgcctggaactgtccgacatctatcagatcccgagcgtggacagcgccgacaacctgagcgagaagctggagagggagtgggatagagagctggcctccaaaaagaatcccaagctcatcaacgccttgcggcgatgcttcttttggaggtttatgttctacggcatcttcctctacctgggagaggtgacgaaggccgtgcagcccctcctgctgggcagaatcatcgcatcttacgaccccgacaataaggaggaaaggtccatcgcgatctacctgggcattgggctgtgcctcctgtttatcgtgcggaccctgctgctgcatcccgccatcttcggactccaccatatcgggatgcagatgcggatcgcaatgttctcactgatctacaagaagaccctgaagctctccagccgggtgctggacaagataagcatcggccagctggtgtccctgctgagcaacaacctgaataagttcgacgaggggctggccctggcccatttcgtgtggatcgcccccctgcaagtggcactgctgatgggcctgatctgggagctgctgcaggctagcgctttctgcggcctcggcttcctgattgtcctcgccctgttccaggccgggctgggcaggatgatgatgaagtaccgggaccagagggcaggcaagataagcgagcggctggtgatcacctccgagatgatcgagaacattcagagcgtgaaggcctactgctgggaggaggcaatggagaagatgatcgaaaacctgcggcagaccgagctgaaactcaccaggaaagccgcgtacgtgaggtactttaactcctccgccttttttttcagcggcttttttgtggtgtttctgagcgtactgccctatgccctcatcaaaggcattatcctgcgcaagatctttacaaccatctcgttctgcatcgtgctgcgaatggccgtgacccgccagttcccgtgggccgtccagacctggtacgactccctcggcgcgatcaacaaaatacaggacttcctgcagaaacaggagtacaaaaccctggagtacaacctcaccaccacggaggtggtgatggaaaacgtgaccgccttctgggaggaaggctttggcgaactgttcgagaaggccaagcagaacaacaacaaccgcaaaaccagcaacggggatgacagcctgttcttcagcaacttctccctgctcggaactcccgtgctgaaggacatcaacttcaagatagagcgcggccagctcctggccgtggccggctccaccggcgccggcaagaccagcctgctcatggtgataatgggggaactggagccctcggaggggaagatcaaacactccggccgaataagcttctgtagccagttctcctggatcatgcccggcacgatcaaggaaaacatcatcttcggcgtctcctacgacgagtaccggtaccgaagcgtgattaaggcctgccagctggaagaggacatcagcaagttcgccgagaaggacaacatcgtgctgggcgagggcggcatcacactgagcggcggccagagggcaaggatcagcctggctcgggcggtgtataaggacgccgacctgtaccttctggacagcccctttggatacctggatgtgctgaccgagaaggagatcttcgagagctgtgtgtgcaaactgatggccaataagacccgtatcctggtgaccagcaagatggagcatctcaagaaagccgataagatcctgatcctgcacgaaggctccagctacttctacggcaccttttccgagctgcagaacctgcagcccgatttctccagcaagctgatggggtgcgactcctttgaccagttcagcgccgagagacgcaactccatactgaccgaaaccctgcaccgattttccctcgagggcgatgcgccggtgtcctggaccgagaccaagaagcagagcttcaagcagaccggcgagtttggggaaaagaggaagaactcgatactgaaccccatcaactccatcaggaaattcagcattgtgcagaagacccccctgcagatgaacggcatcgaggaagacagcgatgagcccctggagaggaggctgtccctggtgccggactccgagcagggcgaggccatactgcccaggatctccgtgatcagcaccgggcccaccctgcaggcgaggaggcgacaatccgtactgaatttgatgacgcacagcgtgaaccagggccagaacatccaccgtaagaccaccgccagcacgcgcaaggtgagcctcgcgccccaggccaacctgaccgagctggacatctacagcaggcggctttcccaggagaccggcctggagatctccgaggagatcaacgaggaggacctgaaggagtgctttttcgacgacatggagagcatccccgccgtgaccacctggaacacctacctcaggtacatcaccgtgcacaagagcctgatctttgtcctgatctggtgcctcgtgatcttcctcgccgaggtggccgcctccctggtggtgctgtggctgctcggcaacacaccactgcaggacaagggcaacagcacccactcccgtaataactcctacgccgtgataataaccagcaccagcagctactacgttttttacatctacgtcggggtggccgataccctgctggccatgggtttcttcaggggcctgcccctggtgcatacgctgatcaccgtgagcaagatcctgcaccataagatgctgcactccgtgctgcaggcccccatgagcaccctgaataccctgaaggcaggcggaatccttaacaggttttccaaggacatcgccatcctggacgacctcctgcccctgaccatctttgacttcatccaactgctgctgatagtcatcggcgcaatcgcagtggtggcagtgctgcaaccctacatcttcgtcgccaccgtgccggtgatcgtggcctttataatgctgcgggcctactttctccagaccagccaacagctgaagcagctcgagagcgagggcaggagccccatatttacccacctggtgaccagcctgaaggggctgtggaccctgagggccttcggcaggcagccctacttcgagaccctgttccacaaggcactgaacctgcacaccgccaactggtttctgtacctgagcaccctgaggtggttccagatgaggatcgagatgatcttcgtgatcttctttatcgccgtcaccttcatcagcatcctgacgacgggcgagggcgagggccgggttggcatcatcctgaccctcgccatgaacatcatgagcaccctccagtgggccgtgaacagcagcatcgacgtggacagcctgatgcggtccgtcagccgcgtgttcaaatttatcgacatgcccaccgaaggtaaacctaccaagtcaacgaagccctataagaacggccagctgagcaaggtcatgatcattgagaattcccacgtgaagaaggacgacatctggccaagcgggggccagatgaccgtgaaggatctgaccgccaagtacaccgagggggggaacgccatcctggagaacatcagctttagcatctcccccgggcagagggtggggctgctgggccgaaccgggagcggcaagagcaccctgctgagcgccttcctacgcctgctcaacaccgagggcgaaatccagatcgacggcgtctcctgggacagcatcaccctgcagcagtggcgcaaggccttcggcgtcattccccagaaggtgtttatctttagtggcaccttcaggaagaacctcgacccctacgaacaatggtccgatcaggaaatctggaaggtggccgacgaggtgggcctgcggagcgtgatcgagcaattccctggtaagctggactttgtcctggtggacggcggctgcgtgctcagccacggccacaagcagctgatgtgcctggcccggtccgtgctgagcaaagcgaaaatcctgctgctggacgagccctccgcccacctggacccggtgacctaccaaatcatcaggcggacgctgaagcaagccttcgccgactgcaccgtcatactgtgcgaacacaggatcgaggccatgttagagtgccagcagttcctggtgattgaggagaataaggtgcgccagtacgacagcatccagaaactgctgaacgagcgaagcctgttccgccaggccatcagccccagcgaccgcgtgaagctctttccccacaggaacagcagcaaatgcaagtccaagccgcagatcgcggccctcaaggaggagaccgaggaggaggtgcaggacacgcgtctg

SEQ ID NO: 19 - DNA, 4440 bp, Artificial Sequence
  Synthetic polynucleotide
atgcagaggtccccccttgagaaggccagcgtggtgagcaagctgttcttcagctggaccaggcccatcctgcggaagggctataggcagaggctggaactgagcgacatctatcagataccctccgtagacagcgccgacaacctttccgagaagctggagagggagtgggacagggagctggcctccaagaagaaccccaagctcatcaacgccctgcggagatgcttcttttggaggtttatgttctacggcatcttcctgtacctgggcgaggtaactaaagccgtgcagcccctgctgctcggcaggatcatcgccagctacgaccccgacaacaaggaagagcgctccatcgccatatacctcggcataggcctgtgcctgctgttcatcgtgaggaccctcctcctgcaccccgcaatcttcggcctgcaccacatcggtatgcagatgaggatcgccatgttctcactcatctacaagaaaacgctgaagctgtcctccagggtgcttgacaagatcagcatcggacagctggtgagcctgctcagcaacaatctgaacaagttcgacgagggcctggccctggcccatttcgtgtggatcgcccccctgcaggtcgccctgctgatgggcctcatctgggagctgctgcaggccagcgccttctgcggactcggcttcctcatcgtgctggcgctttttcaagccgggctgggccgaatgatgatgaagtacagggatcaacgggccggcaagatctccgagcggcttgtgatcaccagcgagatgatagagaacatccagagcgtcaaggcctactgctgggaggaggccatggagaagatgatcgagaacttgcgtcaaaccgagctgaagctgacccggaaggccgcctacgtgcgatacttcaactcgtccgcgttcttcttcagcggctttttcgtggtgttcctgagcgtgctgccctatgccctgatcaagggcatcatcctgaggaaaatcttcaccaccatctccttctgtatcgtgctgcgaatggccgtgaccaggcagttcccctgggccgtgcaaacctggtacgacagcctgggggccatcaacaagatccaggactttctgcagaagcaggaatataagaccctggagtacaacctgaccactaccgaggtggtgatggaaaacgtgaccgccttctgggaggaggggtttggggaactgtttgaaaaggccaagcagaataacaacaaccggaagaccagcaacggcgacgacagcctgttcttcagcaacttcagcctgctcggcacccccgtcctgaaggacatcaatttcaagatcgagaggggccagctgctggccgtcgcgggcagcactggcgcgggcaagacctccctgctaatggtaatcatgggcgagctcgaaccctccgaggggaaaatcaagcacagcgggcggatcagcttctgttcccaattcagctggataatgcccgggaccatcaaggagaatatcatcttcggtgtgagctacgacgagtaccggtacaggtccgtgatcaaggcctgccagctcgaggaggatatcagcaagttcgccgagaaggacaacatcgtgctcggggagggcggtataaccctgagcggcgggcagcgggccaggatcagcctggccagggccgtgtacaaggacgcggatctgtacctgctggacagcccgttcgggtacctggacgtgctgaccgagaaggagatcttcgagagctgcgtctgcaagctgatggccaacaaaacccggatcctcgtcaccagcaaaatggaacacctgaaaaaggccgacaaaatcctgatcctgcacgaaggctcgtcctacttctacggcaccttcagcgaactgcagaacctccaacccgacttttcctccaagctgatgggctgcgattccttcgatcagttcagcgccgagaggaggaacagcatactgaccgagaccctgcataggttcagcctcgagggcgatgcccccgtgtcctggaccgagaccaaaaaacagtccttcaagcagaccggggagttcggggagaagcgcaagaacagcatcctgaacccgatcaacagcatccgtaagttcagcattgtgcaaaaaacccccctgcaaatgaatggcatcgaggaagactccgacgagcccctggagcgccggctgagcctggtccccgacagcgagcagggggaggcgatcctgcccagaatctctgtgataagcaccggccccacgctgcaagcgagacgacggcagtccgtgctcaatctgatgacccactcggtcaaccagggccagaacatccacaggaagaccaccgcctcgactaggaaggtcagcctcgcgccccaggccaacctgaccgagctggacatttacagccgaaggctgtcgcaggagaccggtctcgaaatatctgaggagatcaacgaggaggatctgaaggagtgcttcttcgacgacatggagagcatccccgccgtcaccacctggaacacctacctgcggtatatcacggtgcacaagagcctgatcttcgtgctgatctggtgcctggtgatcttcctagccgaggtcgccgcctccctcgtggtgctgtggctgctgggaaacacccccctgcaagacaagggcaattccacccacagcaggaacaactcctatgccgtcatcatcaccagcacgagcagctactacgtgttctacatctatgtgggagtcgccgacacactgctggccatgggcttcttcagggggctgcccctggtccacacgctgatcaccgtcagcaagatcctgcaccataagatgctccacagcgtcctgcaggcgcccatgtcaacgctgaacaccctgaaggccggtgggatcctgaacaggttcagcaaggacatcgccatcctggacgacctgctccccctgaccatcttcgactttatccagctgctcctgatcgtgatcggcgccatcgccgtggtggccgtcctccagccctacattttcgtggcgacagtccccgtcatcgtggccttcatcatgctgcgcgcctacttcctgcagactagccagcagctgaagcagctggaaagcgaaggaaggagccccatcttcacccacctcgttacatcactcaagggcctgtggaccctgagagccttcgggcgccagccctattttgagacgctgttccacaaagccctgaacttgcataccgccaattggttcctctacctgagcaccctgcggtggtttcagatgcgcatcgagatgatcttcgtcatcttcttcatagcggtaacctttatttccatcctgaccacgggcgagggcgagggccgtgtgggcatcatcctgaccctggccatgaacataatgtcgaccctgcagtgggctgtgaacagcagcatcgacgtggacagcctcatgaggagcgtgagcagggtgttcaagttcattgacatgcccacggagggaaagcccaccaaaagcacaaaaccctacaagaatggccaactaagcaaagtcatgatcatcgagaactcccacgtgaaaaaggacgacatctggccctccggcggacagatgaccgtgaaggacctgaccgccaagtacaccgagggcggcaacgcaatactggagaacatcagcttctcgatatcccccggccagcgcgtgggcctgcttggcaggaccggcagcggaaagagcaccctgctcagcgctttcctgaggctcctgaataccgagggcgagatacagatagatggcgtgagctgggactccatcaccctgcagcagtggcggaaggccttcggcgtgatcccgcagaaggtcttcatcttctccggcacctttcgtaagaacctcgacccctacgagcagtggagcgaccaggagatctggaaggtcgcggacgaagtggggctgaggagcgtcatcgagcagttccccggcaagctggacttcgtgctggtggacgggggctgcgtgctgagccacggccataaacagctgatgtgcctggcacggagcgtgctgtccaaggcgaagatactgctcctggacgagcccagcgcgcacctggatccagtcacctaccagatcatcaggaggaccctgaagcaggccttcgccgactgtaccgtgatcctgtgcgaacacaggatcgaggccatgctcgaatgccagcagttcctggtgatcgaggagaacaaggtgcggcagtacgacagcatccagaaactgctgaacgagcggagcctgttccggcaggccatcagccccagcgatagggtgaaactgttcccccaccggaactccagcaagtgcaaaagcaagccccagatcgccgccctgaaggaggagaccgaggaggaagtgcaggacaccaggctg

SEQ ID NO: 20 - DNA, 4440 bp, Artificial Sequence
  Synthetic polynucleotide
atgcagcggtcccccctggagaaggcctccgtggtgagcaagctgttcttctcgtggaccaggcccatcctcaggaagggctatcgccagcggctggagctgtccgacatctaccagatcccctcggtggatagcgccgacaacctgtccgagaagcttgagcgggagtgggatagggagcttgccagcaagaagaacccgaaactgatcaacgccctgaggcgctgcttcttttggcgcttcatgttctacggcattttcctctacctcggcgaagtgaccaaggccgtgcagccccttctcctggggaggatcatcgccagttacgatcccgacaacaaagaggagcggagcatagccatctacctcggaatcggcctgtgcctcctgttcatcgtgaggaccctgctgctgcaccccgcaatcttcggcctgcaccacatcggcatgcagatgcggatcgcgatgttctccctgatttacaagaagaccctgaagctgagcagccgcgtgctggacaagatcagcataggccaactggtgtccctgctctccaacaacctgaacaagttcgacgagggcctcgccttggcccacttcgtgtggatcgccccgctgcaggtcgccctgctgatgggcctgatatgggagctgctgcaggccagcgccttctgtgggctgggcttcctgatcgtgctggccctgtttcaagccggcctgggcaggatgatgatgaagtaccgggatcagcgcgccggcaaaatctccgaacggctggtgatcacctcggagatgatcgagaatatccagagcgtgaaggcctactgctgggaggaggcgatggagaagatgatagagaatctgcgccagaccgagctaaagctgacccggaaggccgcctatgtcaggtatttcaattccagcgcctttttcttcagcggcttctttgttgtgttcctgagcgtgctgccctacgccctgatcaaaggaatcattctccggaaaatcttcaccaccatctccttttgtatcgtgcttaggatggccgtgacccgacagtttccctgggccgtgcagacctggtacgatagcctgggcgccatcaataaaatccaggacttcctgcaaaagcaggaatacaagacgctagagtacaacctgaccaccaccgaggtggtaatggagaacgtaaccgccttctgggaggagggcttcggggaactcttcgaaaaggccaagcagaataataacaacaggaagacgtccaacggagacgactccctcttcttcagcaacttcagcctgctggggacccccgtcctgaaagacatcaatttcaaaatcgagcggggccagctcctggccgtggccgggagcaccggtgccgggaagacgagcctgctgatggtgatcatgggtgagctggagccctccgaggggaagatcaagcacagcgggcgtataagcttctgtagccagttctcgtggatcatgcccggcaccatcaaggagaatatcatcttcggcgtgagctacgacgagtatcgatacaggagcgtgatcaaggcctgccaactggaggaggatatctccaagttcgccgagaaggacaacatcgtgctcggcgaggggggcataaccctgagcggcggccagagggcgcggatcagcctggccagggccgtgtacaaggacgccgacctgtacttgctggacagcccgtttgggtacctcgacgtgctgaccgagaaggagatcttcgagagctgcgtgtgtaagctgatggccaacaagaccaggatcctggtgacgagcaaaatggagcatctgaagaaggccgacaaaattctgatactgcatgagggcagcagctatttctacggaaccttcagcgagcttcagaacctgcagcccgacttcagcagcaagctgatgggctgcgacagcttcgaccagttcagcgccgagcgcaggaatagcatcctgaccgagaccctgcaccggtttagcctcgaaggagacgcgcccgtgagctggaccgagaccaagaagcagagcttcaagcagacaggcgagttcggcgagaagaggaagaatagcatcctgaaccccatcaacagcatcaggaagttctccatcgtgcagaagacccccctgcaaatgaacggcatcgaggaggatagcgatgaacccctcgagaggaggctgagcctggtgccggacagcgagcagggagaggccatcctgccgaggatctccgtgatcagcaccggccccaccctgcaggcccggaggaggcagagcgtcctcaatctgatgacgcacagcgtcaatcagggccagaacatccaccgaaaaacaaccgcctccacccgcaaagtgagcctggccccccaggctaatctgacagagctcgacatatactcccggaggctgagccaagagaccggcctggagatctccgaagagattaatgaggaggacctgaaggagtgctttttcgacgacatggagtccatccctgccgtgaccacctggaacacctacctgcggtatatcaccgtgcacaagtccttgatcttcgtcctgatctggtgcttggtgatcttcctggctgaggtggccgcctccctggtggtgctttggctgctggggaacaccccgctgcaggacaaaggtaactctacacactcgcggaacaactcctatgcggtcatcattacgagcacctcctcctactatgtgttctacatctacgtgggcgtggccgacaccctgctggccatgggcttcttccgtggtctgccgctggtgcacacactcatcaccgtgagcaaaatcctgcaccacaagatgctgcactccgtgctgcaggccccgatgtccaccctgaacaccctaaaggctggcggcatcctgaacaggttcagcaaggacatcgccatcctggacgacctgctgcccctgaccatcttcgatttcattcaactgctgctgatcgtgataggcgcgatcgccgtcgtggccgtgctgcagccctacatcttcgtggcgacggtccccgtgatagtggccttcataatgctgagggcttacttcctgcaaacctcccaacagctgaagcagctcgagtccgagggcaggagccccatctttacccacctggtgacgagcctgaaggggctctggacgctgcgggcgttcggccgccagccgtacttcgaaaccctgttccataaggccctgaacctgcacaccgccaactggttcctctacctctccaccctgcggtggttccagatgcggatcgagatgatcttcgtgatcttcttcatcgccgtaaccttcatcagcatcctgaccactggcgagggcgagggcagggtgggaatcatcctcacccttgccatgaatatcatgagcacactgcagtgggccgtgaatagctccatcgacgtggactccctgatgcggtccgtgagccgagtgttcaaattcatcgacatgcccaccgaggggaagccaactaagtccaccaagccgtacaagaacggccagctgagcaaagtgatgatcatcgagaacagccatgtgaagaaggacgatatttggcccagcgggggccagatgaccgttaaagacctgaccgccaagtataccgagggggggaacgccattctggagaacatcagcttctccatcagccccgggcagcgggtgggcctgctgggccggaccggcagcgggaagtccacactcctgtccgccttcctgaggctgctcaatacggagggcgaaatacagatcgacggcgtgagctgggactcaatcacgctgcagcagtggaggaaggcattcggggtcatcccgcagaaggtgttcatcttttccggcaccttccgtaagaacctcgacccctacgagcagtggagcgaccaggaaatctggaaggtggccgacgaggtgggcctgaggtccgtgatcgagcagttccccggcaagctggacttcgtgctcgtggacggcgggtgcgtgctgtcccacggccacaagcagctgatgtgtctggccaggagcgtgctgagcaaggccaagatcctgctcctggacgagcccagcgctcacctggaccccgtgacgtaccagatcatccgacgaaccctcaagcaggccttcgccgactgcacagttatcctctgcgaacacaggatcgaagccatgctcgagtgccagcagttcctggtcatagaggagaacaaggtgcggcaatatgacagcatccagaagctgctgaacgagaggagcctgttcaggcaggcaatcagtccctcggaccgcgtgaagctgtttccccaccggaatagctccaagtgcaagtcaaagccccagatcgccgccctgaaggaggagaccgaggaggaggtgcaggatacccgcctg

SEQ ID NO: 21 - DNA, 4440 bp, Artificial Sequence
  Synthetic polynucleotide
atgcagcggagccccctggagaaggcgagcgtggtgagcaagctgttcttcagctggacccgccccatcctgcgaaagggctacaggcagcggctggaactgagcgatatctaccagatcccgagcgtggatagcgccgacaacctgtccgagaaactggagagggagtgggacagggagctggcaagcaaaaaaaatccgaagctgatcaacgccctgaggaggtgcttcttttggcggttcatgttctacgggatcttcctgtacctgggcgaagtaaccaaggccgtccagccactgctgctgggtaggatcatcgccagctacgaccccgacaataaggaggaaaggagcatcgcgatctacctgggcatcggcctgtgcctgctgtttatcgtcaggacgctgctgctgcacccggccatcttcgggctccaccacatcgggatgcagatgcgaatcgccatgttcagcctgatctacaagaagaccctgaagctgtccagcagggtcctggacaagatcagcattggccagctggtgagcctgctgtccaacaatctgaacaaattcgacgagggcctggccctggcgcatttcgtgtggatcgcccccctgcaagtggccctgctgatgggcctgatctgggagctgctgcaggccagcgccttttgcggcctggggttcctgatcgtgctggccctgttccaggccgggctcggtaggatgatgatgaagtacagggaccagcgagccggcaaaatctcggagaggctggtgatcacctccgaaatgatagagaatattcagtccgtgaaggcctactgctgggaggaggccatggagaaaatgatcgagaacctgcgccagaccgagctgaagctgaccaggaaggccgcctacgtgagatacttcaactcatccgccttcttcttttccggcttcttcgtggtcttcctgagcgtgctgccctacgccctgatcaagggcataatcctcaggaaaatcttcaccaccatctctttctgcatcgtgctgaggatggccgtgaccaggcaattcccctgggccgtccagacctggtacgatagcctgggcgccatcaataagatccaagacttcctgcagaagcaggaatacaagaccctggagtacaacctcaccaccaccgaggtggtgatggagaacgtcaccgccttctgggaggaaggcttcggcgagctgttcgagaaggcgaagcagaacaacaacaaccgcaagaccagcaatggtgacgactcgctcttcttctcaaacttcagcctactgggcacgcccgtgctgaaggacattaacttcaagatcgagcggggacagctgctcgccgtggccggaagcaccggcgccggcaagaccagtctgctgatggtgatcatgggcgagctggagcccagcgaggggaagataaagcacagcgggaggatcagcttctgcagccagttcagctggatcatgcccggcaccatcaaggagaacatcatcttcggcgtgagctacgacgagtacaggtaccgaagcgtgatcaaggcctgccagctggaggaggatatcagcaagttcgccgagaaggacaacatcgtgctgggcgagggcggcatcacgctcagcggtggccaaagggcccggatctccctcgccagggccgtgtacaaggacgccgacctgtacctgctcgacagccccttcgggtacctcgatgtgctgaccgaaaaggagatcttcgagtcctgcgtgtgcaagctgatggcgaacaagacccggattctcgtgaccagcaaaatggagcatctcaagaaggccgacaagatcctgatcctgcacgaaggcagcagctatttctacggcaccttcagcgagctccagaacctgcagcccgacttcagctccaagctcatgggctgcgacagcttcgatcagttcagcgccgaaaggcgcaactccatcctgacggagaccctgcacaggttcagcctcgagggcgacgcccccgtctcgtggaccgagaccaaaaagcagagcttcaagcagaccggcgagttcggcgagaagcgaaaaaacagcatcctgaaccccatcaatagcatcaggaaattctccatcgtgcagaagaccccgctgcagatgaacggcatcgaggaggacagcgacgagcccctggaaaggaggctcagcctggtgccggacagcgaacagggagaggccatcctgcctaggatcagcgtgatcagcaccggccccacactgcaggccaggaggaggcagtccgtgctcaacttgatgacccacagcgtcaaccaggggcagaacatccacaggaagaccaccgcctccaccaggaaggtgagcctcgccccgcaagccaacctcaccgagctggacatctactccaggaggctgagccaggagaccggcctggaaatctccgaggagatcaacgaggaggacctgaaggagtgtttcttcgacgacatggagagcatccccgccgtgacgacctggaacacctacctgaggtacatcaccgtccacaagtccctgatctttgtgctcatctggtgtctggtcatctttcttgcggaggtggccgcaagcctggtcgtgctgtggctgctgggaaacaccccactgcaggacaagggtaacagcacccacagcaggaacaatagctacgccgttataatcaccagcacctcctcctattatgtgttctacatctatgtgggtgtggccgataccctgttagccatgggctttttccggggcctgcccctggtgcacaccctaatcaccgtgagcaaaatcctccaccacaagatgctgcattccgtgctgcaggcccccatgagcaccctgaacaccctgaaggcgggaggcatcctcaacaggttctccaaggacattgccatcctcgatgatctgctgcccctgaccatcttcgacttcatacagctgctgctgatagtcatcggcgccatcgccgtcgtggcggtgctccagccctacatctttgtggccacggtgcccgtgatcgtggcgtttatcatgctgcgggcctacttcctgcagaccagccagcagctgaagcaactggaatccgagggcaggagcccgatcttcacccacctcgtgacctccctcaaaggcctctggaccctgcgggcctttgggaggcagccctatttcgagaccctgttccacaaggccctgaacctccacaccgccaactggtttctgtacctgtcgacgctgcggtggttccagatgcgcatcgaaatgatcttcgtgattttcttcatcgccgtgacattcatcagcattctgaccaccggcgagggcgaggggagggtgggcatcattctgaccctggcaatgaacatcatgtcgaccctgcagtgggccgtgaactcaagcatcgacgtggacagcctgatgaggtccgtttccagggtgtttaaattcatcgatatgcccaccgagggcaagcccaccaagagcaccaagccctataaaaacggccagctctccaaagtgatgatcatcgaaaacagccacgtgaagaaagacgacatctggcccagcggggggcagatgaccgtgaaggacctgactgccaagtacaccgaggggggcaacgccatcctggaaaacatcagcttttccatcagccccggccagagggtcgggctgctggggaggaccgggagcggcaagagcaccctcctgagcgcgttcctgcggctgctgaacaccgagggcgagatacagatcgacggggtatcgtgggacagcatcaccctgcagcagtggcggaaggccttcggcgtgatcccccagaaggtgtttatattcagcggcaccttccgaaagaacctggacccctacgagcagtggagcgaccaggagatctggaaggtggccgacgaggtgggcctgaggtcagtgatcgagcagttccccgggaagctggacttcgtgctggtggacggcgggtgcgtgctcagccatggccacaagcagctgatgtgcctggcccgcagcgtgctgagcaaggccaagatcctcctgctggatgagcccagcgcccacctggatcccgtgacctaccaaatcatcaggaggaccctaaagcaggccttcgccgactgcaccgttatcctgtgcgagcaccggatcgaagccatgctggagtgccagcagttcctggtgatcgaggagaataaggtgcggcagtacgacagcatccaaaagctgctgaacgaaaggagcctgttcaggcaggccatcagcccgtccgatcgcgtgaagctgttcccccacaggaactcatccaagtgcaagagcaagccacagatcgctgccctcaaggaggagaccgaggaggaagtgcaggacaccaggctc

SEQ ID NO: 22 - DNA, 4440 bp, Artificial Sequence
  Synthetic polynucleotide
atgcagaggtccccgctggagaaggcgtcggtcgtgagcaagctgttcttctcctggactaggcccatcctgcggaagggctaccggcagaggctcgagctgtccgacatttatcagatccccagcgtggacagcgccgacaacctgagtgagaagctggagagggagtgggaccgggagctggccagcaaaaaaaacccaaagctgatcaacgcactgaggaggtgcttcttctggcgttttatgttttacggcatcttcctgtatctgggagaggtcacgaaggccgtgcagcccctgctgctgggcaggatcatcgcgagctatgaccccgacaacaaggaggaaaggagcatcgcgatctacctggggatcggcctgtgcctgctcttcatcgtgaggaccctcctgctgcaccccgccatcttcggcctccaccacatcggaatgcagatgaggatcgccatgttcagcctgatctacaaaaagaccctcaagctgtcctccagggtgctggataagatcagcatcggccagctggtgagcctgctgagcaacaacctgaacaagttcgacgagggcctggcgctggcccacttcgtgtggatcgccccgctccaggtcgccctcctgatgggactgatctgggaactcctgcaggccagcgccttctgcggcctgggattcctcatcgtgctggccctgttccaggctggcctcggtcggatgatgatgaagtaccgggaccagcgtgccggcaagatcagcgaaaggctggtgatcacctccgagatgatcgaaaatatacagtctgtgaaagcctactgctgggaggaggccatggagaagatgatcgagaacctgaggcagaccgagctgaagctgacccgaaaggccgcctacgtgaggtatttcaattccagcgccttcttcttcagcggcttcttcgtggtgttcctgagcgtgcttccctacgccctgatcaagggaatcatcctcaggaagatcttcaccacgatcagcttctgcatcgtgctgaggatggccgtgaccaggcagtttccctgggccgttcagacctggtacgatagcctgggagccatcaataagatccaggacttcctgcagaagcaggagtacaagaccctggagtataacctgaccaccaccgaggtcgtgatggaaaacgtgaccgccttctgggaagagggattcggcgagctcttcgagaaggccaagcagaacaacaacaaccggaagaccagcaatggcgatgattccctgttcttcagcaacttcagcctgctggggacccccgtactgaaggacatcaacttcaagatcgagagaggccagctgctggccgtagccgggagcaccggggcgggcaaaacctccctcctgatggtgatcatgggagagctggagccgtccgagggcaagatcaagcatagcggtaggatctccttttgttcccagttctcgtggataatgccgggcaccatcaaggagaacataatattcggcgtcagctatgacgagtacaggtaccgttccgtgattaaggcctgccagctggaggaggatatcagcaagttcgccgagaaggacaacatcgtgcttggcgagggagggatcaccctgagcggcgggcagcgtgcccggatatccctggcgagggccgtgtacaaggacgccgatctctacctgctggatagtcccttcgggtacctggacgtgctgaccgagaaagagatcttcgagtcctgcgtgtgtaaactgatggccaataagaccaggatcctggtcaccagcaagatggagcatctgaagaaggccgataaaatcctgatcctgcacgagggcagcagctacttctacgggaccttttccgagctccagaacctgcagcccgacttcagcagcaagctgatgggctgcgattccttcgaccagtttagcgccgagcggcgcaacagcatcctgacggagaccctgcacaggttcagcctcgaaggcgacgcgcccgttagctggaccgagacgaagaagcagtccttcaagcaaaccggggagttcggtgaaaagcggaagaacagcatcctgaaccccatcaatagcatacgtaagttcagcatcgtgcagaagactcccctgcagatgaatggcatcgaggaagactccgacgagccactcgagcggaggctgagcctggtgcccgacagcgagcagggagaagccatcctccccaggatttccgtgatcagcaccggccccaccctgcaggccaggcggaggcagagcgtgctcaacctgatgacccacagtgtgaatcagggccagaatatccatcgcaagacgacagcctctacccgaaaggtctccctggccccccaggccaacctgaccgagctggacatatactccaggcgtctgagccaggagactgggctggagatctccgaggagataaacgaggaagacctgaaggagtgctttttcgacgacatggagtccattcccgcggtcacgacctggaacacctacctccgctacatcacggtgcataaaagcctgatcttcgtgctcatctggtgtctggtgatcttcctggccgaagtggccgcgagcctggtggtgctgtggctcctcgggaacacaccgctgcaagacaagggcaacagcacccatagccgaaacaactcctacgccgtgattataaccagcaccagctcttattacgtcttctacatctatgtgggggtcgccgataccctcctggccatgggcttcttcaggggcctgcccctggtccataccctgatcaccgtcagcaagatactccaccacaagatgctgcatagcgtgctccaagccccgatgagcaccctgaatactctgaaggcaggcggcattctcaacaggttctcgaaggacatcgccatcctggacgacctgctccccctgaccatcttcgatttcatccagctgctcctgatagtgatcggcgccatcgccgtggtggcggtgctccagccctacatcttcgtcgccaccgtccccgtaatcgtggccttcatcatgctgcgcgcctatttcctgcagaccagccagcagctgaagcagctggagtccgaggggaggagcccaatctttacccacctcgtgaccagcctgaaagggctgtggaccctgagggcctttgggaggcaaccctattttgagaccctgtttcacaaggccctgaacctccacaccgcgaactggttcctctatctcagcaccctgaggtggttccaaatgcggatcgagatgatctttgtgatcttctttatcgccgtgaccttcatcagcatcctgaccaccggggagggcgagggccgcgtcggcatcatcctgaccctcgccatgaacatcatgtccaccctccagtgggccgtgaatagcagcatcgacgtggacagcctgatgaggtccgtgtctcgagtgttcaagtttatcgacatgccgaccgaggggaagcccaccaagagcactaagccctacaagaacgggcagctgtccaaggtgatgatcatagaaaacagccacgtgaagaaggacgatatctggccgtccggcggccagatgaccgtgaaggacctgaccgcgaagtatacggagggcggcaacgccatcctcgagaacataagcttcagcataagccccggccagcgagtgggtctgctgggcaggaccgggagcggcaagagcaccctgctgagcgccttcctccgtctgctgaacaccgagggggaaatccaaatcgacggcgtgagctgggacagcatcaccctccagcagtggcgcaaggccttcggcgtgatcccccagaaggtcttcatcttctccggcaccttcaggaagaacctcgacccctacgagcagtggtcagatcaagagatctggaaggtggccgatgaggtgggcctgaggtcagtgatcgagcagttccccggcaagctcgattttgtgctggtggatggtgggtgcgtgctgtcccacggccacaagcaactgatgtgcctggcaaggagcgtcctgtcgaaggccaagatcctgctgctggacgaaccctccgcccacctggaccccgtgacttatcagatcatccgaagaaccctgaagcaggccttcgccgattgtaccgtgatcctctgcgagcaccggatcgaagccatgctggagtgccagcagttcctggtgatcgaggaaaacaaggtgcgtcagtacgacagcatccagaagctgctgaatgagcgcagcctgttccgacaggccatctcccccagcgaccgggtgaagctgttcccccaccggaatagctcgaagtgcaagtccaaaccccagatcgcagccctaaaggaggagacggaagaggaggtgcaggacacccggctc

SEQ ID NO: 23 - DNA, 4440 bp, Artificial Sequence
  Synthetic polynucleotide
atgcagcggtcccccctcgagaaggccagcgtggtgagcaagctattcttcagctggacccgtcccatcctgcggaagggctaccgccagcgcctggagctgtccgatatataccagatcccctccgtcgatagcgcggacaacctgtccgagaagctggagcgtgagtgggaccgcgagctggccagcaagaagaaccccaagctgatcaacgccctgcgcaggtgctttttctggaggttcatgttctacgggatcttcctgtatctgggcgaggttaccaaggccgtgcaacccctgctcctcgggcgcatcatcgccagctacgaccccgataacaaggaggagaggagcattgccatctatctgggcataggcctgtgcctgctgtttatcgtgaggaccctgctgctgcatcccgcgatcttcggcctgcaccacatcggcatgcagatgaggatcgccatgttctccctgatttacaaaaagaccctgaaactgagctcccgcgtgctcgacaagatctccatcgggcaactggtgtccctgctgtcgaataacctgaacaagtttgacgaggggctggcccttgcccactttgtctggatcgccccgctccaggtggccctcctgatggggctcatctgggagctgctgcaggccagcgccttttgcggcctgggctttctgatcgtactcgccctcttccaggccggtctaggccggatgatgatgaagtaccgagaccaacgggccggcaagatctccgagaggctggtcatcaccagcgaaatgatcgagaatatccagagcgtgaaagcttactgttgggaagaggccatggaaaagatgatcgagaacctgcggcaaaccgagctgaagctgaccaggaaggccgcgtacgtccggtacttcaacagcagcgccttcttcttctccggcttcttcgtggtgttcctgagcgtgctgccttacgccctgatcaaggggatcatcctcaggaagatcttcacgaccatctccttttgcatagtcctgcgcatggccgtgacccgccagttcccctgggccgtgcagacgtggtacgacagcctgggggccatcaacaagatccaggacttcctgcaaaagcaagagtacaaaaccctggaatataacctgaccaccaccgaagtcgtcatggagaacgtgacagccttctgggaggagggcttcggcgagctcttcgaaaaggccaagcaaaacaacaacaacaggaagacctccaatggcgacgacagcctgttcttcagcaacttcagcctgctcgggaccccggtgctgaaggacattaatttcaaaatcgagcggggccagctgctggccgtggccggctccacaggggctggcaagaccagcctcctgatggtgatcatgggggaactcgagccctccgagggcaagatcaagcactccggcaggatcagcttctgcagccagtttagctggatcatgcccggcaccattaaagaaaacatcatcttcggggtgagctacgacgaatacaggtacaggagcgtgatcaaggcctgccagctggaggaagatatctccaaatttgcggaaaaggataacattgtgctgggcgaaggcgggatcactctcagcggtggtcagcgcgcccggataagcctggcgcgcgccgtgtacaaggacgccgacctgtatctgctggactcccccttcggctacctggacgtgctcaccgagaaggagatcttcgagtcctgcgtgtgcaaactcatggccaacaagaccaggatcctcgtcacgagcaagatggagcacctgaaaaaggccgacaagatcctgatcctgcatgagggcagcagctacttctatggcaccttcagcgagctgcagaacctgcagcccgacttcagctctaagctgatggggtgcgatagtttcgaccaattcagcgccgagaggaggaatagcatcctgacggaaaccctccacaggttcagcctggagggcgacgcaccggtgagctggaccgaaaccaagaagcaaagcttcaagcagaccggggagtttggggagaagaggaagaacagcatcctgaaccccataaactccatccgcaagttcagtatcgtgcagaagaccccgctgcaaatgaacggcatcgaagaggacagcgatgagcccctggaacggaggctgtctctggtgccggacagcgagcagggcgaggcaatactgccccgcatcagcgtgatctccactggcccgacgctgcaagcccggcggcgccagtctgtgctcaacctcatgacccatagcgtgaaccagggccagaacatccaccgcaaaacgaccgccagcacgcgtaaggtgtccctggccccgcaagccaacctcaccgagctggacatctactcccgaaggctgagccaggagacaggtctggagatctcggaggagatcaatgaagaggaccttaaggagtgcttcttcgacgacatggaaagcatccccgccgtgaccacgtggaacacctacctgaggtacatcaccgtgcacaagagcctgatcttcgtgctgatctggtgcctggtgatcttcctggccgaggtggcggccagcctggtggtgctgtggctgctcggcaacacccccctgcaggacaagggcaactccacccacagcaggaacaacagctacgccgtgatcatcaccagcacgtccagctactacgtcttctacatctatgtgggcgtggctgacacccttctggccatgggcttctttcgcgggctgcccctggtccacaccctcataacggtgtccaagatcctgcaccacaaaatgctgcacagcgtgctgcaggcccccatgagcaccctgaacaccctcaaggccggcgggattctgaaccggttcagcaaggatatcgccatcctggacgacctgctgcccctgaccatcttcgacttcatccagctgctgcttatcgtgatcggcgctatcgccgtggtggccgtactgcagccctacatcttcgtggcgacggtgccagtgatcgtcgccttcatcatgctgagggcctacttccttcagaccagccaacagctgaagcagctggagagcgaggggcgcagccccatcttcacccacctggtcaccagcctgaagggtctgtggaccctgagggcctttggccggcagccgtacttcgagaccctgttccacaaagccctcaacctgcataccgcaaactggttcctctacctctccaccctgcggtggttccagatgcggatcgagatgatcttcgtgattttcttcatcgccgtgacctttatcagcatcctgaccaccggtgagggcgaggggcgggtcgggatcatcctgaccctggccatgaacatcatgtccaccctgcagtgggccgtcaacagctccatcgacgtagacagcctgatgaggagcgtctccagggtgttcaagttcatcgacatgccgacggagggcaagccgaccaaatccacgaagccctacaagaacggccagctcagcaaagtgatgatcatcgagaactcccacgtgaagaaggacgatatctggcccagcggcggacagatgaccgtgaaggacctgacggccaagtacaccgaaggcggcaacgctatactggaaaacatcagcttcagcattagcccggggcagagggtgggcctgctgggccggaccggaagcggcaagagcaccctgctgtccgccttcctgcggctgctgaacaccgagggggaaatacagatagacggcgtgagctgggacagcatcaccctgcagcaatggcggaaggccttcggcgtcatcccccaaaaggtcttcatcttctccggcacctttagaaagaacctggacccctacgagcaatggtcagaccaggagatctggaaggtggccgatgaggtgggcctgcggagcgtgatcgagcagttccccggcaagctggacttcgtgctggtggacggcggctgcgtcctgagccacggccacaagcaactgatgtgcctcgccaggagcgtcctgtcaaaggctaagatcctgctcctcgacgagcccagcgcccaccttgaccccgtgacctaccagatcatccggaggacgctgaagcaagccttcgccgattgcaccgtcatcctgtgcgagcacaggatcgaggccatgctggaatgccaacaatttctggtgatcgaggagaacaaggtgaggcagtacgactccatccagaagctgctgaacgaaaggagcctgtttaggcaggccataagccccagcgatagggtcaagctcttcccgcacaggaacagcagtaaatgcaagtcaaagccccagatcgccgccctgaaggaggaaaccgaggaggaggtgcaggacacccgcctg

SEQ ID NO: 24 - DNA, 4440 bp, Artificial Sequence
  Synthetic polynucleotide
atgcagcggagccccctggagaaggcatccgtcgtgtctaagctgttcttcagctggaccagacccatcctgcggaagggctaccggcagcggctcgagctgagcgacatctaccagatcccctccgtggacagcgccgacaacctgagcgagaagctggagcgagagtgggacagggagctggccagcaagaaaaaccccaagctgatcaacgccctgcgccgctgcttcttctggcggttcatgttttatggcatctttctgtacctgggcgaagtgacgaaggccgtgcagcccctgctgctgggccgtattatcgcgagctatgatcccgacaacaaggaggagaggagcatcgccatctacctgggcatcggcctgtgcctcctgttcatcgtacgcaccctgttactgcaccccgccatcttcggcctgcaccacattgggatgcagatgcggatcgccatgttcagcctgatctacaagaagaccctgaagctgagttccagggtgctggacaagatcagcataggccagctggtgtccctgctcagcaacaacctcaacaagtttgatgagggcctggccctagcccatttcgtgtggatcgccccgctgcaggtggccctgctgatgggcctgatctgggagctgctgcaagccagcgccttctgcggcctagggttcctgatcgtgctggccctgttccaggcgggcctgggcaggatgatgatgaagtaccgcgaccagagggctgggaagatcagcgagaggctggtcattacctcagaaatgatcgagaatatccagtccgtgaaggcctactgctgggaggaggccatggagaaaatgatcgagaacctcaggcagaccgaactgaagctgacacggaaggccgcctacgtgaggtacttcaacagcagcgcgtttttcttctcgggcttctttgtggtgttcctgtccgtgctgccgtacgccctcatcaagggcatcatactgcggaagatctttaccaccatcagcttctgtatcgtgctgaggatggccgtgaccaggcagttcccctgggccgtccagacctggtacgacagcctgggtgccattaataagatccaagacttcctgcagaagcaggagtacaagaccttggagtacaacctcaccactaccgaggtggtcatggagaacgtgaccgccttctgggaggagggcttcggcgagctgtttgaaaaggcgaaacagaacaataacaaccgcaagaccagcaacggcgacgactccctgttctttagcaacttcagtctgctgggcaccccggtgctgaaggacatcaactttaagatcgagaggggacagctgctcgccgtggccggtagcaccggcgccggcaagaccagcctgctgatggtgatcatgggcgagctggagcccagcgagggcaaaataaagcacagcggcaggatcagcttttgtagccagttcagctggatcatgcccggcaccatcaaggaaaacatcattttcggcgtgagctacgacgaatacagatacagaagcgtgatcaaggcctgccaactggaggaagacatcagcaagttcgccgagaaggacaatatcgtgctcggcgagggcggcatcaccctgagcggcggccagagagcccgcatctcgctggccagggccgtctacaaggacgccgatctgtatctgctggacagccccttcggctacctggacgtgctgaccgaaaaggagatcttcgagagctgcgtgtgtaaactgatggccaacaaaacccggatcctggtgacgagcaagatggagcatctgaagaaggccgacaaaatcctgatactgcacgaggggagcagctacttctacggcaccttcagcgagctgcagaatctgcagcccgactttagcagcaaactgatgggctgcgacagcttcgaccagttctcggccgaacggcgtaattccatcctcaccgagaccctgcacaggttctccctggagggcgacgcccccgtgtcctggaccgagaccaaaaagcagtcattcaagcaaaccggtgagttcggcgagaagcgaaaaaactctatcctgaaccccatcaacagcatccgcaaattcagcatcgtccagaagaccccactccagatgaacgggatcgaggaggactccgatgagcccctggagaggaggctcagcctggtgcccgactccgagcagggggaggccatcctgcccaggatctcggtcatcagcaccgggcccaccctgcaagccaggcggcgacagagcgtcctgaacctgatgacccacagcgtgaaccagggccaaaatatccacaggaagaccaccgcaagcacccgcaaggtcagcctggcgccccaggccaacctgacggagctcgacatctattccaggcggctgagccaggagaccggcctggagatctccgaggagatcaatgaggaggacctgaaagaatgcttcttcgacgacatggagagcatccccgccgtgacgacctggaatacctacctccgttatatcaccgtgcacaagagcctgatcttcgtgctgatctggtgcctggtgatcttcctggccgaggtcgccgcatcgctggtggtgctgtggctgctggggaacaccccgctgcaggacaagggcaactccacccacagcaggaacaatagctacgccgtgatcatcaccagcaccagcagctactatgtgttctacatctacgtgggtgtggccgacaccctgctggccatgggcttcttcagaggcctacccctagtgcacaccctgatcaccgtctcgaagatcctccaccacaagatgctgcacagcgtgctgcaagcccccatgtccaccctcaataccctgaaagccggcggaatcctcaaccgattttccaaggacatcgccatactggatgacttactgcctttgaccatcttcgacttcatccagctgctgctgatcgtgatcggggccatcgccgtcgtggccgtcctgcagccctacatcttcgtggcaacggtgcccgtgatcgtagcgtttattatgctccgggcctacttcctgcagacgtcccagcagctcaagcaactggaatcagagggcaggtcccccatcttcacccacctggtgacctccctcaaaggactgtggaccctgagggcgttcgggcgccagccctactttgagaccctgttccacaaggccctcaacctgcacaccgccaactggttcctgtatctctccaccctgcggtggttccagatgcggatcgagatgatatttgtcatctttttcatcgccgtgacctttatcagcatcctcaccaccggcgagggcgagggccgtgtcggcattatcctgaccctggcaatgaacatcatgagcaccctgcagtgggccgtgaattcctccatcgacgtggacagcctgatgaggagcgtcagcagggtgttcaagttcatcgacatgcccacggagggcaagccgaccaagtcgaccaagccctacaagaacggccaactgagcaaggtgatgatcatcgaaaacagccatgtgaagaaggacgacatctggcccagcgggggccagatgaccgtgaaggacctgactgccaagtacaccgaggggggcaatgccatactggagaacatcagcttctccatcagccctggacagagggtcggcctgctggggcggaccggttcgggcaagagcacccttctgagcgccttcctgcgactgcttaacaccgaaggcgagattcagatagacggcgtcagctgggactccatcaccctccagcagtggaggaaggcctttggggtgatcccccagaaggtgttcatcttcagcggaaccttccgtaagaacctggacccatacgagcagtggagcgaccaagagatctggaaggtggcggacgaagtcggcctgaggagcgtgatcgagcagtttcccggcaaactcgacttcgtgctggtggacggcgggtgcgtgctgagccacggccacaaacaactcatgtgcctggcccggagcgtgctgtccaaagccaagatcctgctgctggacgagcccagcgcccacctggaccccgtcacctaccagatcatcaggaggactctgaagcaggcgttcgccgactgcaccgtgatcctgtgtgagcacaggatcgaggccatgctggagtgccagcagttcctagtgatcgaggagaacaaggtgaggcagtatgacagcatccagaagctgctaaacgaacgctccctgtttaggcaggccatctcccccagcgaccgtgtgaagctgttcccccacaggaattcctccaaatgcaagagcaagccgcagatcgccgcgctgaaggaggagaccgaagaggaagtccaggatacgaggctg

SEQ ID NO: 25 - DNA, 4440 bp, Artificial Sequence
  Synthetic polynucleotide
atgcagaggagccccttagagaaggcctccgtggtgtccaagctgtttttcagctggaccaggccgatactcaggaagggctacaggcagaggctggagctcagcgacatctaccagatcccgagcgtggactcggcggataacctgagcgagaagctggagcgagagtgggaccgagagctggccagcaaaaagaaccccaagctgatcaacgccctgagacggtgcttcttctggcggtttatgttctacggcatcttcttgtacctcggggaggttaccaaggccgtgcagcccctcctgctcggccgtatcatcgcaagctacgatcccgacaacaaggaggaaaggagcatcgccatctatctgggcatcggcctctgcctcctgttcatcgttaggacactgctgctgcatcccgccattttcggcctgcaccacatcgggatgcagatgaggatcgccatgttttccctgatctacaagaagaccctgaagctgtcgagcagggtgcttgacaagatctccatcggccaactggtgtccctgctctccaacaacctgaacaagttcgacgagggcctggccctggcccacttcgtgtggatcgcccccctgcaggtggcgctgctgatggggctgatttgggagctgctgcaggccagcgccttctgcgggctgggctttctcattgtgttggccctgttccaggccggcctcggccgcatgatgatgaagtaccgcgatcagagggccgggaagatctccgagcgcctcgtgatcacctcggaaatgatcgagaacatccagagcgtgaaggcctattgttgggaggaagccatggagaagatgatcgagaacctgaggcagacggagctcaagctcacccggaaggcggcctatgtgaggtacttcaacagctccgccttcttcttcagcgggtttttcgtggtgttcctgagcgtgctgccctacgccctgatcaagggcatcatcctgcggaagatcttcaccaccattagcttctgcatcgtgctgcggatggccgtgacccggcagttcccctgggccgtgcagacctggtacgatagcctgggcgccatcaacaaaatccaggacttcctgcagaagcaggagtacaagaccctcgagtacaacctgaccaccaccgaggtcgtgatggagaacgtgaccgccttttgggaggagggtttcggcgagctgttcgagaaagccaagcagaacaacaacaacaggaagaccagcaacggcgacgactccctgttcttcagcaactttagcctcctgggcacccccgtgctgaaggacatcaatttcaagatcgagaggggccagctgctggccgtggccggtagcaccggcgccgggaaaaccagcctgctgatggtgatcatgggcgagctggagcccagcgagggaaagatcaaacacagcgggaggatctccttctgctcccagttcagctggatcatgccgggcaccataaaggagaacataatcttcggcgtcagctacgacgagtaccgatacaggagcgtcatcaaagcctgccagctcgaggaggacatctccaagttcgccgagaaggataacatcgtgctgggcgaggggggcatcacgctgtccggcggtcagagggccaggatttccctcgctagggccgtgtataaggatgccgacctctatctgctggacagcccctttggttacctggacgtgctgaccgaaaaggaaattttcgagagctgcgtgtgcaagctgatggccaacaagacgcgcatactggtcaccagcaagatggagcatctgaagaaggccgacaagatcctgatcctgcacgagggcagcagctacttctacgggacattcagcgagctgcagaacctacagcccgacttcagctcgaagctgatggggtgcgacagcttcgatcagttcagcgccgaacgccgcaattccatcctgaccgaaaccctgcataggttctctctggagggcgacgcccccgtgtcctggaccgaaaccaagaagcagagcttcaagcaaaccggggagttcggcgagaaaaggaagaacagcatcctgaaccccatcaatagcatcaggaagttcagcatcgtgcagaaaacccccctgcagatgaacggcatcgaggaggattccgacgaacccctcgagaggcggctgagcctagtgcccgactccgagcagggggaagccatactgccccgcatcagcgtgatctccaccggccccaccctgcaggccaggcggaggcagagcgtgctgaacctgatgacgcacagcgtgaaccagggccagaacatccacaggaagacgaccgccagcacccggaaggtgtcgctcgccccccaggccaatctgaccgagctggacatctacagccggcggctgtcgcaggagacggggctggagatcagcgaggagatcaacgaggaggacctgaaggagtgcttcttcgacgacatggagtccatccccgccgtcaccacgtggaacacctaccttaggtacatcaccgtgcacaaatccctgatattcgtgctgatctggtgcttggtgatcttcctcgccgaggtggccgccagcctggtggtcctgtggctcctgggcaacaccccactgcaggataagggcaacagcacccactcccgcaacaacagctacgcggtgatcatcacaagcacgagcagctactacgtcttttacatctacgtcggggtcgccgacaccctcctggccatgggcttctttcgcgggctgcccctggtgcacaccctgatcaccgtgagcaagattctccaccacaagatgctgcactccgtgctgcaggcccccatgagcaccctgaacaccctgaaggccggtggcatcctgaatcggttcagcaaggatatcgccatactggacgacctgctgcccctgaccatcttcgacttcattcagctcctactgatcgtgatcggcgccatcgccgtcgtggccgtcctgcagccgtacatcttcgtggcaacggtgcccgtgatcgtggcctttatcatgctgcgggcctacttcctccagacctcccagcagctcaagcagctggagagcgaggggcgcagccccatcttcacccacctggtgacctccctgaaaggcctgtggaccctcagggccttcgggcggcagccctatttcgagaccctctttcacaaagccctgaacctgcacactgccaactggttcctgtatctgagcaccctgcgctggttccagatgaggatcgagatgatcttcgtgatcttcttcatcgccgtgacctttatcagcattctcaccacaggagaaggggagggccgcgtgggcatcattctcacactcgccatgaacatcatgagcaccttgcaatgggccgtgaacagcagcatcgacgtggacagcctgatgaggagcgtgtcccgcgtgtttaagttcatcgacatgccgaccgagggcaagcccaccaagagcaccaagccctataagaacggccagctgagcaaggtgatgatcatcgagaacagccacgtcaagaaggacgacatatggccaagcggcggacagatgaccgtgaaggacctgaccgccaagtacacggagggaggcaacgcgatcctggagaacatcagcttcagcatctcccccggccagcgcgtgggcctgctcggcaggaccggcagcggcaagagcaccctactctccgcgtttctgcggctgctgaacaccgagggcgaaatccagatcgacggagtgagctgggacagcatcaccctgcagcaatggaggaaggccttcggggtgatcccccagaaggtgttcatcttcagcggtaccttcaggaaaaacctggatccctacgagcagtggagcgaccaagagatctggaaggtggccgacgaggtggggctgcgttccgtgatcgaacagtttcccggcaaactcgacttcgtgctggtcgacggcggctgtgtgctcagccacggccataagcagctgatgtgcctggccaggtccgtcctcagcaaggccaagatcctgctcctggacgagccctccgcccacctggaccccgtgacctaccagatcatcaggaggaccctgaagcaggccttcgccgactgcactgtgatcctctgcgagcacagaatcgaggccatgctcgaatgccagcagttcctggtgatcgaagagaacaaggtgaggcagtacgattccatccagaagctgctgaacgagaggagcctgttcaggcaggccatcagccccagcgatagggtgaagctgttcccccatcggaactcctccaagtgcaagagcaagccacagatcgccgcgctgaaggaggagaccgaggaggaagtccaggacacccggctg

SEQ ID NO: 26 - DNA, 4440 bp, Artificial Sequence
  Synthetic polynucleotide
atgcagaggtcccccctggagaaagcctccgtggtttccaagctcttcttcagctggacccgccccatcctgaggaagggctaccggcagcgcctggagctgagcgacatctaccagatcccgagcgtcgacagcgccgacaacctgagcgagaagctggagcgggagtgggatcgggagctcgcctccaagaaaaaccccaagctgatcaacgccctgaggcggtgcttcttctggcggttcatgttttacggcatcttcctgtacctgggagaggtcacgaaggccgtgcagcccttgctgctgggaaggatcatcgccagctacgaccccgacaacaaggaggaaaggtccattgcgatatatctgggaatcggcctgtgtctgctgttcatcgtaaggaccctcctgctccatcccgccatcttcgggctccaccacatcggcatgcagatgaggatcgccatgtttagcctcatctacaaaaagaccctgaagctgtcctccagagtgctggataagatctccatcggccaactggtgtccctcctgagcaacaacctgaacaagttcgacgagggcctggccctggcccatttcgtgtggatcgcccccctccaggtggcgctcctgatgggcctgatctgggagctgctgcaggccagcgccttttgcggactggggtttctgatcgttttggccctgttccaggccggactgggcaggatgatgatgaagtaccgggatcaaagagcgggaaagatctccgagaggctggtcataaccagcgaaatgatcgagaatatccaaagcgtgaaggcctactgctgggaggaggccatggagaagatgatcgagaacctgcgccaaaccgaactcaagctgacccgaaaggcggcctacgtgcggtatttcaatagcagcgccttcttcttcagcggcttcttcgtcgtcttcctctccgtcctgccctacgccctgatcaaggggatcatcctgaggaagatctttaccaccatctcgttttgcatcgtgctgcgaatggccgtgaccaggcaattcccctgggccgtgcagacctggtacgactccctgggagccatcaacaaaatccaagactttctgcagaagcaggagtacaaaaccctggagtacaacctgaccaccacggaggtcgtgatggagaacgtcaccgccttctgggaggagggctttggcgagctgttcgagaaggccaagcagaacaacaacaataggaaaaccagcaacggcgacgatagcctgttcttcagcaacttctccctgctggggacgcccgtcctgaaggacataaacttcaagatcgagaggggccagctgctggccgtggccggcagcaccggcgccgggaagacgagcctcctgatggtaatcatgggcgagctggagccctccgaaggcaagatcaagcattccggcagaatcagcttctgctcccagttctcgtggattatgcccggcacgatcaaagagaacatcatattcggcgtgtcctacgacgagtaccggtacaggagcgtgatcaaggcgtgccagctggaggaagacatcagcaagttcgccgagaaggacaacatcgtgctcggcgagggcggaatcacgctgagcggcggacagagggcccgcatcagcctggctagggccgtgtacaaagacgccgacctgtacctgctggacagccccttcggttacctcgacgtgctgacggagaaggagatcttcgagtcctgtgtctgcaagctgatggccaataagaccaggatcctggtgaccagcaagatggagcacctgaagaaggccgacaagatactgatcctccacgagggctcctcgtacttctacggcaccttctccgagctgcagaacctgcagcccgatttcagcagcaaactgatgggctgtgactcctttgatcagttcagcgccgagaggcggaatagcatcctgaccgagaccctgcaccggttctctctggaaggtgatgcccccgtgagctggaccgagaccaagaagcagagcttcaagcagaccggcgagtttggcgagaagaggaagaacagcatcctgaatcccatcaacagcatccggaagttcagcatcgtgcagaaaacccccctccagatgaacggcatcgaggaggatagcgacgagcccctggagaggcggctcagcctggtgcccgacagcgagcagggggaggccatcctgcccaggatcagcgtcatcagcactggccccaccctgcaagcccggcggaggcaaagcgtgctaaacctcatgacccactccgtgaaccaggggcagaatatccatcggaagaccaccgccagcacccggaaggtgagcctggcaccgcaggccaacctgaccgagctggatatctacagccgacggctgagccaggaaaccggactcgagatcagcgaggagatcaacgaggaggacctgaaggagtgcttcttcgacgacatggagagcatccccgccgttaccacctggaacacctacctgcgctacatcaccgtgcacaaaagcctgatctttgtgctgatatggtgcctggtgatctttctggccgaggtggccgccagcctggtggtgctgtggctactgggcaatacccccctgcaggataagggcaacagcacccacagcaggaacaacagctacgccgtgatcatcaccagcacctccagctactacgtcttctatatctacgtgggcgtggcggacaccctgctggctatggggttctttcggggcctgccactggtgcacaccctgataaccgtcagcaagatcctgcatcacaagatgctgcacagcgtcctgcaagctcccatgagcaccctgaacaccctcaaagccggcggaatcctgaaccgcttcagcaaggacatcgccatcctggacgatctgctgcccctcaccatcttcgattttatccagctcctgctgatcgtgatcggcgcgattgcagtggtggccgtgctgcagccctacatcttcgtggccaccgtgccggtgattgtggccttcatcatgctccgggcctacttcctgcagaccagccagcagctgaagcagctcgagagtgaaggccgcagccccatcttcacccaccttgtgaccagcctgaagggcctgtggaccctgagggccttcgggaggcaaccctacttcgagacgctgtttcacaaggccctcaacctccacaccgccaactggttcctctacctgagcaccctgcgctggttccaaatgaggatagaaatgatcttcgtgatattcttcatcgccgtgacctttatcagcatactgaccaccggcgaaggcgagggcagggtcgggatcatcctgaccctcgccatgaacatcatgtccaccctgcaatgggccgtgaactccagcatcgacgtggacagcctgatgaggagcgtcagccgcgtcttcaagttcatcgacatgcccaccgagggcaagcccaccaagagcaccaagccctacaagaacggccagctgagcaaggttatgatcatcgagaacagccacgtcaagaaagacgatatatggcccagcggcggccagatgaccgtcaaggacctgaccgccaagtacaccgaaggcggcaacgccatcctggagaacatcagcttcagcattagccccggccagcgagtgggcctgctcggaaggaccggcagcgggaagagcaccctgctgagcgcgtttctgaggctgttgaacaccgagggcgaaatccagatcgatggcgtgagctgggacagcatcaccctccaacagtggaggaaggccttcggcgtgattccccagaaggtgttcatctttagcggcaccttcaggaagaacctcgacccctacgagcagtggagcgaccaagagatctggaaggttgccgacgaggtgggcctcaggagcgtgatcgagcaatttcccggcaagctggacttcgtgctggtggacgggggctgcgtgctgagtcacgggcacaagcagctgatgtgcctggcccggtccgtgctgagcaaggccaagatcctcctgctggacgagccctccgcgcacctggatcccgtgacctaccagattatccggaggaccctgaagcaggcatttgccgactgcaccgtgatcctgtgcgagcaccgtatcgaggcgatgctggaatgccagcagtttctagtgatcgaagagaacaaagtcaggcagtacgactccatccagaagcttctgaacgagaggagcctgttccggcaggccatctccccctccgaccgcgtgaagctgttcccccatcggaactccagcaagtgcaagagcaagccccagatcgccgccctgaaggaggagaccgaggaggaggtgcaggacaccaggctc

SEQ ID NO: 27 - DNA, 4440 bp, Artificial Sequence
  Synthetic polynucleotide
atgcagaggtccccgctggagaaggcctccgtggtgtccaagctgttcttctcctggacccggcccatcctccggaagggctatcggcagaggctggagctgagcgacatttaccagatcccaagcgtcgacagcgccgacaacctgagcgagaagctggagcgggagtgggaccgtgagctggcaagtaagaagaaccccaagctgataaatgccctgaggcgatgttttttttggaggttcatgttctacggcatctttctctacctcggagaggtgaccaaggccgtgcagcccctgctgctggggcggatcatcgccagctacgatcccgacaacaaggaagagaggtccatagccatttacctgggcatcgggctctgcctcctcttcatcgtccgcaccctgctgctgcaccccgccatcttcgggctgcaccacatcggcatgcaaatgcgcatcgccatgttctcactgatctacaaaaagacgctgaagctgagcagcagggtgctggacaagatctccatcgggcaactggtgagcctcctgtccaacaacctgaacaagttcgacgagggactggccctggcccacttcgtgtggatcgcccccctccaggtggccctgctgatggggctcatatgggagcttctgcaggccagcgccttctgtggcctggggtttctgatcgtgctggccctgtttcaggccggtctcggccgaatgatgatgaagtacagggaccaaagagcgggcaagatctccgagcgactggtgatcacctccgagatgatcgagaacatccagtcggtgaaagcctactgctgggaggaggccatggaaaagatgatcgagaacctcaggcagaccgaactgaagctcaccaggaaggccgcctacgtgcggtatttcaattcgtcagccttcttctttagcggcttttttgtggtgttcctctctgtgctgccctatgcactgatcaagggaatcatcctgaggaaaatcttcaccaccatcagcttctgtatcgtgctccgcatggccgtgaccaggcagttcccctgggccgtgcagacctggtacgactccctgggggccatcaataagatccaggatttcctgcagaaacaggagtacaaaaccctggagtataatctgaccaccactgaggtggtaatggagaacgtcaccgccttctgggaggagggcttcggcgagctgttcgagaaggccaagcaaaacaataacaacaggaagacgagcaacggggatgacagcctcttcttcagcaacttttccctgctggggactcccgtcctgaaggatatcaacttcaagatcgaaaggggacagctgctggccgtcgccggcagcaccggggccggcaagacaagcctgctgatggtcatcatgggcgaactggagcctagcgagggcaagatcaaacacagcgggaggatctccttctgctcccagttcagctggatcatgcccggcaccatcaaggagaacatcatcttcggggtcagctacgacgagtaccgctatcgcagcgtgatcaaggcctgtcagctcgaggaggacatcagcaaattcgccgagaaggacaacatcgtgctcggcgagggcgggatcaccctcagcggcgggcaacgggcccggatcagcctcgccagggccgtgtacaaggatgcggacctgtacctgctggacagccccttcggctacctggacgtgctcaccgagaaggagatcttcgagtcctgcgtgtgtaagctcatggcgaacaagaccaggatcctcgtgaccagcaagatggagcatctgaaaaaggcggacaaaatccttatcctgcacgaggggtcctcctatttctatggcaccttctccgagctccagaacctgcagccggacttcagctccaagctgatgggctgcgatagcttcgaccagttctccgccgagcgcaggaactccatactcaccgagacgctgcacaggttctcgctcgaaggcgacgcccccgtgtcctggaccgagaccaagaaacagtcctttaagcagaccggcgagttcggagagaagaggaagaacagcatcctgaaccccatcaactccatcaggaagtttagcatcgtgcaaaagaccccgctccagatgaatggcatcgaggaagactccgacgaacccctcgagcgccggctgagcctggtgccggatagcgagcaaggggaggccatcctgccccgcatctccgtgatctccaccgggcccacgctgcaggccaggcggaggcagagcgtgctgaacctgatgacccactctgtgaaccagggccagaacatacaccggaagaccaccgcctcgacccgcaaggtgagtctcgccccccaggcaaacctcaccgagctagatatctatagcaggaggctgagccaggagacgggcctcgagatcagcgaggaaataaatgaagaggacctgaaggagtgcttcttcgacgatatggagagcataccggccgtgacgacctggaatacctacctgaggtacatcaccgtgcacaaatcgctgatcttcgtgctgatttggtgcctggtaatcttcctggctgaggtggccgcctccctcgtggtgctgtggctgctcggcaacacgcccctgcaggacaagggcaacagcacccattccaggaacaattcgtatgccgtgatcatcacctccaccagcagctattacgtgttctacatttacgtgggggtggccgacaccctgctggccatggggttcttcagagggctgccactggtccacaccctgataaccgtgtccaagatcctgcaccacaagatgctgcacagcgtgctgcaggcccccatgagcacgctgaacacgcttaaggccggcggtatcctgaaccgcttctccaaggacatcgccatcctcgacgacctgctccccctgaccatcttcgacttcatccagctgctgctcatcgtgataggcgcaatcgccgtggtggccgtgcttcagccgtacatcttcgtggccacggtgcccgtgatcgtggccttcatcatgctgagggcctacttcctccaaaccagccagcagctgaagcaactggagtccgagggccggagccccatcttcacccacctcgtgaccagcctgaaaggcctgtggaccctgagggccttcggccggcaaccctattttgagaccctgtttcacaaggccctcaatctccataccgccaattggttcctctacctgagcaccctgaggtggtttcagatgcgtatcgagatgattttcgtaatattcttcatcgccgtgaccttcatctccatcctgaccaccggcgagggagaaggccgcgtggggatcatcctgaccctcgccatgaacatcatgagcaccctgcagtgggccgtgaactccagcatcgacgtcgactccctgatgcgcagcgtgtccagggtgttcaagttcatcgacatgccaactgagggcaagcccaccaagagcacgaagccatataagaacgggcaactgagcaaggtgatgatcatcgagaacagccacgtcaagaaggacgatatctggcccagcgggggccagatgaccgtgaaggacctcaccgccaaatataccgaggggggtaacgccatcctggagaacatcagcttctccatcagtcccgggcagcgggtcggcctgctcggccgaaccggcagcgggaagagcacgctgctctccgcgttcctgcggctgctgaacaccgagggcgagattcagatcgacggggtctcctgggatagcattaccctgcagcagtggcggaaggcgttcggcgtcatcccccagaaggtgttcatcttctcgggcacgttcagaaagaatctggatccctacgagcagtggagcgaccaggagatctggaaggtggccgacgaagtgggcctaaggagcgtgatagaacagttccccggcaagctggattttgtgctggtcgatggcggctgcgtgctgagccacgggcacaagcagctgatgtgcctggcccggagcgtgctgagcaaggccaagatcctgctgctggacgagccctccgcccacctggacccggtgacctaccagatcatcaggaggaccctcaagcaggccttcgccgactgcaccgtcatcctctgcgaacaccgaatcgaggccatgctcgagtgccagcagttcctggtgatcgaggagaacaaggtgcgccagtacgacagcatccagaagctgctcaatgaacggagcctctttaggcaggccatcagcccgagcgacagggtcaagctgtttccccaccgcaacagctccaaatgcaaaagcaagccccagatcgcggccctgaaggaagagaccgaggaagaggtgcaggacaccaggctc

SEQ ID NO: 28 - DNA, 4440 bp, Artificial Sequence
  Synthetic polynucleotide
atgcagaggtcccccctggagaaggcctccgtggtgagcaagctgttcttcagctggacccggcccatcctgaggaaaggctacaggcagcgactcgagctgtccgacatataccaaatccccagcgtggacagcgcggacaacctgagcgagaagctggagcgcgagtgggacagggagctcgccagcaagaaaaatcccaagcttatcaacgccctgaggcgttgttttttctggcgcttcatgttctacggcatcttcctgtacctgggcgaggtgaccaaggccgtgcaacccctgctgctcgggaggatcatagcctcctacgaccccgacaacaaggaagagaggagcattgccatctacctgggcatcggcctgtgcctgctgttcatcgtgaggacactgctgctgcaccccgccatctttggactccaccacatcggcatgcagatgaggatcgccatgttctcccttatctacaagaaaaccctgaagctcagcagcagggtgctggacaagatcagcatcggccagctcgtgagcctcctgagcaataacctgaacaagttcgacgaaggcctcgccctagcccacttcgtgtggatcgcgcccctgcaggtggccctcctgatgggcctgatctgggagctgctgcaagcctccgccttctgcggcctcggctttctgatcgtgctcgcccttttccaagccggcctcgggcgcatgatgatgaagtacagggaccagcgcgccggcaagatcagcgagaggcttgtgatcaccagcgagatgatcgagaacatccagtctgtcaaagcctactgctgggaggaggccatggagaagatgatcgagaacctgaggcagactgagctcaagctgaccaggaaggccgcctacgtgaggtacttcaactcatcggccttcttcttcagcggcttcttcgtggtgtttctcagcgtcctgccgtacgctctgatcaagggcattatcctgcggaagatcttcaccaccatcagcttctgcatcgtgctccggatggccgtgacgaggcagttcccctgggccgtgcagacctggtacgacagcctgggcgccatcaataaaatccaggactttctccagaagcaggagtacaaaaccctcgagtacaacctgaccaccaccgaggtcgtgatggagaacgtgaccgccttctgggaggagggcttcggcgagctgttcgaaaaggccaagcagaacaataataaccggaagaccagcaacggcgacgactccctcttcttcagcaatttctccctcctgggcacccccgtgctcaaggacatcaattttaagatcgagaggggccagctgctggccgtggccggctccaccggcgccggcaaaacctccctgctcatggtgatcatgggggagctcgagcctagcgagggcaagatcaaacacagcggcaggatctcgttctgtagccagttcagctggatcatgcccggcaccattaaagagaacatcatcttcggcgtgtcctatgacgagtacaggtacaggagcgtgataaaagcctgccagctggaagaagacatctccaaattcgccgagaaggacaatatcgtgctcggtgagggcggcatcacgctgagcggaggccagagggcccggatctcgctcgccagggccgtgtataaggacgcggacctgtatctgctggacagcccctttggctacctggacgtgctgaccgagaaagagatctttgagagctgcgtctgcaagctcatggccaacaagaccagaatcctggtgaccagcaagatggaacatctgaagaaggccgacaagattctcatcctgcacgaggggtccagctacttctatgggaccttctccgagctgcagaacctgcaacccgacttcagcagcaagctgatgggatgcgactcattcgatcaattcagcgccgagcggaggaactccatcctgaccgaaacactccatcggtttagcctggagggcgacgcacccgtctcctggaccgaaaccaagaaacagagcttcaagcagaccggcgagtttggggagaagcgaaagaactccatcctcaacccgatcaacagcatccggaagtttagcatcgtgcagaagacacccctgcagatgaacggcatcgaggaggacagcgacgagccactggagaggcgactgagcctggtgccggacagcgagcagggggaagccatcctgccaaggatctccgtgatcagcaccgggcccaccctgcaggccaggcggaggcaatcggtcctcaatctgatgacccacagcgtcaaccaagggcaaaacatccaccggaagaccacagcgagcacccgaaaggtgtccctggccccccaggccaacctgaccgagctggacatctacagccgcaggctgagccaggagaccggcctggagatcagcgaggagatcaacgaggaggacctgaaggagtgcttttttgacgatatggagagcatccctgccgtgaccacctggaacacctacttgcgttacataaccgtgcacaagagcctgatcttcgtcctgatctggtgcctggtgatcttcctggccgaggtggccgccagcctcgtggtcctctggctgctggggaatacccccctgcaagacaagggaaactctacccatagccgcaacaatagctacgcggtcataataacctccaccagcagctactacgtgttttatatctatgtgggagtggccgacaccctgctggcaatgggcttcttcaggggcctgcccctggtgcacaccctgatcaccgtgtccaagatcctccatcacaaaatgctccactcggtcctgcaggcgcccatgagcacgctgaacaccctgaaggccggcggcatactgaaccgcttcagcaaggacatcgccatcctggatgaccttctccccctcaccatcttcgacttcatccagctcctgctgatcgtgatcggcgccatcgccgtggtggccgtcctgcagccctatatcttcgtggcgaccgtgcccgtcatcgtcgccttcatcatgctgcgagcctacttcctgcaaacgagccagcagctgaagcagctggaaagcgagggccgcagccccatcttcacccacctggtgaccagcctaaagggcctgtggaccctcagggcctttggccgccagccttacttcgaaaccctgttccacaaggccctgaacctccacaccgccaactggttcctgtacctctccaccctgaggtggttccagatgcggatcgagatgatcttcgtcatctttttcatcgccgtgacgttcatcagcatcctgaccacgggcgagggggaaggccgggttggtatcatcctgaccctggccatgaacatcatgagtacactccaatgggccgtgaactccagcatcgacgtggacagcctcatgaggagcgtgagcagggtgtttaagttcattgacatgcccaccgaagggaaacccaccaagagcaccaagccctacaagaacggtcagctgagcaaggtgatgattatcgagaattcccacgtgaagaaggacgacatctggccctccggaggccagatgaccgtgaaggacctcaccgccaaatacacggagggcggcaacgccatcctggagaacatcagcttctccatctcgcccggacagagggttggcctgctgggccggaccgggagcggcaaatcgaccctcctgagcgccttcctgaggctcctcaacaccgagggcgagatccagatcgacggagtaagctgggactccatcacgctgcagcagtggcgaaaggcgttcggggtaatccctcagaaggtcttcatcttcagcggcactttccggaagaatctggacccctacgaacagtggagcgaccaggaaatctggaaggtggccgacgaggtgggccttaggagcgtcatcgagcagttccccgggaagctggacttcgtactggtggacggtggctgcgtgctgagccacgggcacaagcaactgatgtgtctggcccggtcggtgctgtccaaggcgaaaatcctgctcctggacgagcccagcgcccatctggatcccgtgacctaccagatcatacgccggaccctgaagcaggccttcgccgactgcaccgtaatactgtgcgagcaccggatcgaggccatgctggagtgccagcagttcctcgtgatcgaggagaacaaggtaaggcaatatgacagcatccaaaaactgcttaatgaaaggagcctcttcaggcaggccatctccccctccgaccgagtgaaactgttcccccatagaaatagcagcaaatgcaaatccaagccccaaatcgccgccctgaaggaggagacggaggaggaggtgcaagacacccggctg

SEQ ID NO: 29 - DNA, 4440 bp, Artificial Sequence
  Synthetic polynucleotide
atgcagaggagccccctggagaaggccagcgtcgtcagcaagctcttcttcagctggacgaggcccatcctccggaagggttaccggcagcggctggagctgtccgacatctaccagataccctccgtggacagcgccgataacctgagcgaaaagctggaaagggaatgggaccgggagctcgcctccaagaagaaccccaagctgattaacgccctgcggcggtgcttcttctggcgcttcatgttttacggcatcttcctgtacctgggtgaggtgaccaaggccgtgcagcccctgctgctcgggaggatcatcgcgtcctacgaccccgacaacaaggaggagcgaagcatcgccatctatctggggatcgggctgtgcctgcttttcatcgtccgaacactgctgctgcaccccgcgatcttcgggctgcaccatattggcatgcagatgaggatagccatgttcagcctgatctataaaaagaccctgaaactgagctccagggtgctcgacaagatcagcatcggccagctggtgagcctcctgtccaacaacctcaacaagttcgacgagggcctcgccctggcccactttgtgtggattgcccccctgcaggtggcgctgctgatggggctgatctgggagctgctgcaggccagcgctttctgcggtctagggttcctcatcgtgctggccctcttccaggccgggctggggcgtatgatgatgaagtaccgggaccagagggcgggcaagataagcgagcgcctggtgatcacgtccgaaatgatcgagaacatccagtcggtcaaggcctactgttgggaggaagccatggagaagatgatcgagaacctgcgccaaaccgaactgaagctgaccaggaaggccgcctacgtccggtatttcaactcctccgcattctttttctccggcttcttcgtggtgttcctgagcgtgctgccctatgccctgatcaaggggatcatcctgaggaagatcttcaccacgatcagcttctgcatcgtgctcaggatggcggtcaccaggcagttcccctgggccgttcagacatggtacgacagcctgggggccatcaacaagatccaggatttcctgcagaaacaggaatataagaccctggagtacaacctgaccaccacagaggtcgtgatggagaacgtgaccgccttttgggaggaaggctttggggaactgttcgagaaagccaaacagaacaataacaacaggaagaccagcaacggggatgactccctcttcttctccaacttcagcctcctggggacacccgtcctgaaggatatcaatttcaagatcgagcgcggccaactcctggccgtggccggcagcaccggtgccggtaagaccagcctgctgatggtcatcatgggcgagctggagccgagcgaaggcaagatcaaacacagtggccggatcagcttttgcagccagttctcctggattatgcccggcaccatcaaagagaacatcatttttggtgtctcctacgatgagtatcgctaccggagcgtgatcaaggcctgccagctggaggaggacatctcgaagtttgccgaaaaggacaacattgtcctgggtgaaggagggattaccctgagcgggggccagagggcccggatcagcctggcccgcgccgtctacaaggacgccgacctgtacctgctggacagccccttcggatacctggacgtgctgaccgagaaggagatcttcgagagctgcgtctgcaagctgatggccaacaagaccaggatcctggtgaccagcaaaatggaacacctcaagaaagcggacaagatcctgatactgcacgagggcagctcgtacttctacggcaccttcagcgagctgcagaacctgcagcccgacttctctagcaagctgatgggttgcgattccttcgaccagttcagcgccgagaggcggaactccatcctgaccgagaccctgcatcggttctccctggagggcgacgcccccgtgagctggactgaaaccaaaaagcagagcttcaagcagacgggagaattcggcgagaagaggaagaactcgattctgaaccccatcaacagcatccggaagttctccatcgtgcagaagacccccctgcagatgaacgggatcgaagaggactctgatgagcccctggagaggaggctgagcctcgtgcccgactccgagcagggcgaggccatactgccccgtatcagcgtgatcagcaccggccccaccctgcaagcccgcaggaggcagtcggtgctgaacctcatgacgcacagcgtgaatcagggccagaacatccacaggaaaacaactgcgagcacccgcaaggtgagcctggcgccccaggccaacctgaccgagctcgacatctatagccgtcggctgagccaggagaccggcctggagatcagcgaggagattaatgaggaggacctcaaggaatgcttcttcgacgacatggagagcatccccgcggtgaccacctggaacacctatctgaggtacataaccgtgcacaaatccctgatcttcgtcctgatctggtgcctggtgatcttcctcgccgaggtcgccgcgagcctcgtcgtgctgtggctgctgggcaacacccccctgcaggacaagggcaacagcacccatagccgaaataactcttatgccgtgatcatcaccagcacctcgagctattacgtcttctacatctatgtgggggtggccgacacgcttctggcaatgggcttcttcagaggactgcccctagtgcacacgctgataaccgtgagcaagatcctgcaccataagatgctgcactccgtgctccaggcccccatgagcacactcaacaccctcaaagcaggcggcatcctgaatcggtttagcaaggacatcgccatactggacgatctgctgcccctcaccatcttcgacttcatccagctcctgctgatcgtgatcggcgccatcgccgtggtggccgtgttacagccctatatcttcgtggcgaccgtgccggtgatcgtggccttcatcatgctcagggcctactttctgcagacgagccagcagctgaagcagctcgagagcgagggcaggtcccccatcttcacacacctggtgaccagcctgaaaggcctgtggaccctgagggcctttggcaggcaaccctacttcgaaacactctttcacaaagccctcaatctgcacaccgcgaactggttcctgtacctgtccaccctgaggtggttccagatgaggatcgagatgatcttcgtgatcttctttatcgccgtcaccttcatctccatcctgaccaccggcgaaggcgagggccgggtgggcatcatcctgaccctcgccatgaacatcatgagcaccctgcagtgggcggtgaacagctccatcgacgtggattccctgatgagatccgtgagccgggtgttcaaattcatcgacatgcccaccgaggggaagcccaccaagagcacgaagccctacaagaacggccaactgagcaaggtgatgatcatcgagaattctcacgtgaagaaggacgacatctggcccagcggcggacagatgaccgtgaaagacctgaccgccaagtacactgagggcgggaacgccatccttgagaacataagcttcagcatcagccccggtcagagggtgggcctcctgggccggacgggcagcgggaagtccaccctgctgtccgccttcctgcggctgctcaacaccgagggcgagatccagatagatggcgtaagctgggacagcatcaccctgcagcaatggcgtaaggcgttcggcgtgataccgcagaaggtattcatcttcagcgggaccttcaggaagaacctcgacccctacgagcagtggtcggaccaggagatctggaaggtggccgacgaggtcggcctgcgctccgtcatcgagcagtttcccggaaaactggactttgtcctggtggacggaggttgcgtgctgtctcacggtcacaagcagctgatgtgtctggcccgctccgtgctgagcaaggccaagatcctgcttctggacgagcccagcgcccacctggaccccgtgacctaccaaatcatccgccgcaccctgaagcaggccttcgccgactgtaccgtgatactgtgcgagcaccgcatcgaggccatgctggagtgtcagcagttcctggtgatcgaggagaacaaggtgaggcagtatgactccatccagaagctgctgaacgagagaagcctgttcaggcaggccatcagcccctccgacagggtgaagctgttcccccatcggaacagcagcaagtgtaagagcaagccgcagatcgccgccctcaaagaggagaccgaggaagaagtgcaggacacgcgtctg

SEQ ID NO: 30 - DNA, 4440 bp, Artificial Sequence; identical to SEQ ID NO: 5
  Synthetic polynucleotide

SEQ ID NO: 31 - DNA, 4440 bp, Artificial Sequence; identical to SEQ ID NO: 6
  Synthetic polynucleotide

SEQ ID NO: 32 - DNA, 4440 bp, Artificial Sequence; identical to SEQ ID NO: 7
  Synthetic polynucleotide

SEQ ID NO: 33 - DNA, 4440 bp, Artificial Sequence; identical to SEQ ID NO: 8
  Synthetic polynucleotide

SEQ ID NO: 34 - DNA, 4440 bp, Artificial Sequence; identical to SEQ ID NO: 9
  Synthetic polynucleotide

SEQ ID NO: 35 - DNA, 4440 bp, Artificial Sequence; identical to SEQ ID NO: 10
  Synthetic polynucleotide

SEQ ID NO: 36 - DNA, 4440 bp, Artificial Sequence; identical to SEQ ID NO: 11
  Synthetic polynucleotide

SEQ ID NO: 37 - DNA, 4440 bp, Artificial Sequence; identical to SEQ ID NO: 12
  Synthetic polynucleotide

SEQ ID NO: 38 - DNA, 4440 bp, Artificial Sequence; identical to SEQ ID NO: 13
  Synthetic polynucleotide

SEQ ID NO: 39 - DNA, 4440 bp, Artificial Sequence; identical to SEQ ID NO: 14
  Synthetic polynucleotide

SEQ ID NO: 40 - DNA, 4440 bp, Artificial Sequence; identical to SEQ ID NO: 15
  Synthetic polynucleotide

SEQ ID NO: 41 - DNA, 4440 bp, Artificial Sequence; identical to SEQ ID NO: 16
  Synthetic polynucleotide

SEQ ID NO: 42 - DNA, 4440 bp, Artificial Sequence; identical to SEQ ID NO: 17
  Synthetic polynucleotide

SEQ ID NO: 43 - DNA, 4440 bp, Artificial Sequence; identical to SEQ ID NO: 18
  Synthetic polynucleotide

SEQ ID NO: 44 - DNA, 4440 bp, Artificial Sequence; identical to SEQ ID NO: 19
  Synthetic polynucleotide

SEQ ID NO: 45 - DNA, 4440 bp, Artificial Sequence; identical to SEQ ID NO: 20
  Synthetic polynucleotide

SEQ ID NO: 46 - DNA, 4440 bp, Artificial Sequence; identical to SEQ ID NO: 21
  Synthetic polynucleotide

SEQ ID NO: 47 - DNA, 4440 bp, Artificial Sequence; identical to SEQ ID NO: 22
  Synthetic polynucleotide

SEQ ID NO: 48 - DNA, 4440 bp, Artificial Sequence; identical to SEQ ID NO: 23
  Synthetic polynucleotide

SEQ ID NO: 49 - DNA, 4440 bp, Artificial Sequence; identical to SEQ ID NO: 24
  Synthetic polynucleotide

SEQ ID NO: 50 - DNA, 4440 bp, Artificial Sequence; identical to SEQ ID NO: 25
  Synthetic polynucleotide

SEQ ID NO: 51 - DNA, 4440 bp, Artificial Sequence; identical to SEQ ID NO: 26
  Synthetic polynucleotide

SEQ ID NO: 52 - DNA, 4440 bp, Artificial Sequence; identical to SEQ ID NO: 27
  Synthetic polynucleotide

SEQ ID NO: 53 - DNA, 4440 bp, Artificial Sequence; identical to SEQ ID NO: 28
  Synthetic polynucleotide

SEQ ID NO: 54 - DNA, 4440 bp, Artificial Sequence; identical to SEQ ID NO: 29
  Synthetic polynucleotide

SEQ ID NO: 55 - RNA, 47 nt, Artificial Sequence
  Synthetic polynucleotide
gggaaauaagagagaaaagaagaguaagaagaaauauaagagccacc

SEQ ID NO: 56 - RNA, 47 nt, Artificial Sequence
  Synthetic polynucleotide
gggagaucagagagaaaagaagaguaagaagaaauauaagagccacc

SEQ ID NO: 57 - RNA, 145 nt, Artificial Sequence
  Synthetic polynucleotide
ggaauaaaagucucaacacaacauauacaaaacaaacgaaucucaagcaaucaagcauucuacuucuauugcagcaauuuaaaucauuucuuuuaaagcaaaagcaauuuucugaaaauuuucaccauuuacgaacgauagcaac

SEQ ID NO: 58 - RNA, 42 nt, Artificial Sequence
  Synthetic polynucleotide
gggagacaagcuuggcauuccgguacuguugguaaagccacc

SEQ ID NO: 59 - RNA, 47 nt, Artificial Sequence; identical to SEQ ID NO: 56
  Synthetic polynucleotide

SEQ ID NO: 60 - RNA, 145 nt, Artificial Sequence; identical to SEQ ID NO: 57
  Synthetic polynucleotide

SEQ ID NO: 61 - RNA, 42 nt, Artificial Sequence; identical to SEQ ID NO: 58
  Synthetic polynucleotide

SEQ ID NO: 62 - RNA, 47 nt, Artificial Sequence
  Synthetic polynucleotide
gggaauuaacagagaaaagaagaguaagaagaaauauaagagccacc

SEQ ID NO: 63 - RNA, 47 nt, Artificial Sequence
  Synthetic polynucleotide
gggaaauuagacagaaaagaagaguaagaagaaauauaagagccacc

SEQ ID NO: 64 - RNA, 47 nt, Artificial Sequence
  Synthetic polynucleotide
gggaaauaagagaguaaagaacaguaagaagaaauauaagagccacc

SEQ ID NO: 65 - RNA, 47 nt, Artificial Sequence
  Synthetic polynucleotide
gggaaaaaagagagaaaagaagacuaagaagaaauauaagagccacc

SEQ ID NO: 66 - RNA, 47 nt, Artificial Sequence
  Synthetic polynucleotide
gggaaauaagagagaaaagaagaguaagaagauauauaagagccacc

SEQ ID NO: 67 - RNA, 47 nt, Artificial Sequence
  Synthetic polynucleotide
gggaaauaagagacaaaacaagaguaagaagaaauauaagagccacc

SEQ ID NO: 68 - RNA, 47 nt, Artificial Sequence
  Synthetic polynucleotide
gggaaauuagagaguaaagaacaguaaguagaauuaaaagagccacc

SEQ ID NO: 69 - RNA, 47 nt, Artificial Sequence
  Synthetic polynucleotide
gggaaauaagagagaauagaagaguaagaagaaauauaagagccacc

SEQ ID NO: 70 - RNA, 47 nt, Artificial Sequence
  Synthetic polynucleotide
gggaaauaagagagaaaagaagaguaagaagaaaauuaagagccacc

SEQ ID NO: 71 - RNA, 47 nt, Artificial Sequence
  Synthetic polynucleotide
gggaaauaagagagaaaagaagaguaagaagaaauuuaagagccacc

SEQ ID NO: 72 - RNA, 92 nt, Artificial Sequence
  Synthetic polynucleotide
ucaagcuuuuggacccucguacagaagcuaauacgacucacuauagggaaauaagagagaaaagaagaguaagaagaaauauaagagccacc

SEQ ID NO: 73 - RNA, 142 nt, Artificial Sequence
  Synthetic polynucleotide
ugauaauaguccauaaaguaggaaacacuacagcuggagccucgguggccaugcuucuugccccuugggccuccccccagccccuccuccccuuccugcacccguacccccguggucuuugaauaaagucugagugggcggc

SEQ ID NO: 74 - RNA, 142 nt, Artificial Sequence
  Synthetic polynucleotide
ugauaauaggcuggagccucgguggcuccauaaaguaggaaacacuacacaugcuucuugccccuugggccuccccccagccccuccuccccuuccugcacccguacccccguggucuuugaauaaagucugagugggcggc

SEQ ID NO: 75 - RNA, 142 nt, Artificial Sequence
  Synthetic polynucleotide
ugauaauaggcuggagccucgguggccaugcuucuugccccuuccauaaaguaggaaacacuacaugggccuccccccagccccuccuccccuuccugcacccguacccccguggucuuugaauaaagucugagugggcggc

SEQ ID NO: 76 - RNA, 142 nt, Artificial Sequence
  Synthetic polynucleotide
ugauaauaggcuggagccucgguggccaugcuucuugccccuugggccuccccccaguccauaaaguaggaaacacuacaccccuccuccccuuccugcacccguacccccguggucuuugaauaaagucugagugggcggc

SEQ ID NO: 77 - RNA, 142 nt, Artificial Sequence
  Synthetic polynucleotide
ugauaauaggcuggagccucgguggccaugcuucuugccccuugggccuccccccagccccuccuccccuucuccauaaaguaggaaacacuacacugcacccguacccccguggucuuugaauaaagucugagugggcggc

SEQ ID NO: 78 - RNA, 142 nt, Artificial Sequence
  Synthetic polynucleotide
ugauaauaggcuggagccucgguggccaugcuucuugccccuugggccuccccccagccccuccuccccuuccugcacccguacccccuccauaaaguaggaaacacuacaguggucuuugaauaaagucugagugggcggc

SEQ ID NO: 79 - RNA, 142 nt, Artificial Sequence
  Synthetic polynucleotide
ugauaauaggcuggagccucgguggccaugcuucuugccccuugggccuccccccagccccuccuccccuuccugcacccguacccccguggucuuugaauaaaguuccauaaaguaggaaacacuacacugagugggcggc

SEQ ID NO: 80 - RNA, 371 nt, Artificial Sequence
  Synthetic polynucleotide
gcgccugcccaccugccaccgacugcuggaacccagccagugggagggccuggcccaccagaguccugcucccucacuccucgccccgcccccugucccagagucccaccugggggcucucuccacccuucucagaguuccaguuucaaccagaguuccaaccaaugggcuccauccucuggauucuggccaaugaaauaucucccuggcaggguccucuucuuuucccagagcuccaccccaaccaggagcucuaguuaauggagagcucccagcacacucggagcuugugcuuugucuccacgcaaagcgauaaauaaaagcauugguggccuuuggucuuugaauaaagccugaguaggaagucuaga

SEQ ID NO: 81 - RNA, 568 nt, Artificial Sequence
  Synthetic polynucleotide
gccccugccgcucccacccccacccaucugggccccggguucaagagagagcggggucugaucucguguagccauauagaguuugcuucugagugucugcuuuguuuaguagaggugggcaggaggagcugaggggcuggggcugggguguugaaguuggcuuugcaugcccagcgaugcgccucccugugggaugucaucacccugggaaccgggaguggcccuuggcucacuguguucugcaugguuuggaucugaauuaauuguccuuucuucuaaaucccaaccgaacuucuuccaaccuccaaacuggcuguaaccccaaauccaagccauuaacuacaccugacaguagcaauugucugauuaaucacuggccccuugaagacagcagaaugucccuuugcaaugaggaggagaucugggcugggcgggccagcuggggaagcauuugacuaucuggaacuugugugugccuccucagguauggcagugacucaccugguuuuaauaaaacaaccugcaacaucucauggucuuugaauaaagccugaguaggaagucuaga

SEQ ID NO: 82 - RNA, 289 nt, Artificial Sequence
  Synthetic polynucleotide
acacacuccaccuccagcacgcgacuucucaggacgacgaaucuucucaaugggggggcggcugagcuccagccaccccgcagucacuuucuuuguaacaacuuccguugcugccaucguaaacugacacaguguuuauaacguguacauacauuaacuuauuaccucauuuuguuauuuuucgaaacaaagcccuguggaagaaaauggaaaacuugaagaagcauuaaagucauucuguuaagcugcguaaauggucuuugaauaaagccugaguaggaagucuaga

SEQ ID NO: 83 - RNA, 379 nt, Artificial Sequence
  Synthetic polynucleotide
caucacauuuaaaagcaucucagccuaccaugagaauaagagaaagaaaaugaagaucaaaagcuuauucaucuguuuuucuuuuucguugguguaaagccaacacccugucuaaaaaacauaaauuucuuuaaucauuuugccucuuuucucugugcuucaauuaauaaaaaauggaaagaaucuaauagagugguacagcacuguuauuuuucaaagauguguugcuauccugaaaauucuguagguucuguggaaguuccaguguucucucuuauuccacuucgguagaggauuucuaguuucuugugggcuaauuaaauaaaucauuaauacucuucuaauggucuuugaauaaagccugaguaggaagucuaga

SEQ ID NO: 84 - RNA, 118 nt, Artificial Sequence
  Synthetic polynucleotide
gcugccuucugcggggcuugccuucuggccaugcccuucuucucucccuugcaccuguaccucuuggucuuugaauaaagccugaguaggaaggcggccgcucgagcaugcaucuaga

SEQ ID NO: 85 - RNA, 908 nt, Artificial Sequence
  Synthetic polynucleotide
gccaagcccuccccaucccauguauuuaucucuauuuaauauuuaugucuauuuaagccucauauuuaaagacagggaagagcagaacggagccccaggccucuguguccuucccugcauuucugaguuucauucuccugccuguagcagugagaaaaagcuccuguccucccauccccuggacugggagguagauagguaaauaccaaguauuuauuacuaugacugcuccccagcccuggcucugcaaugggcacugggaugagccgcugugagccccugguccugaggguccccaccugggacccuugagaguaucaggucucccacgugggagacaagaaaucccuguuuaauauuuaaacagcaguguuccccaucuggguccuugcaccccucacucuggccucagccgacugcacagcggccccugcauccccuuggcugugaggccccuggacaagcagagguggccagagcugggaggcauggcccuggggucccacgaauuugcuggggaaucucguuuuucuucuuaagacuuuugggacaugguuugacucccgaacaucaccgacgcgucuccuguuuuucuggguggccucgggacaccugcccugcccccacgagggucaggacugugacucuuuuuagggccaggcaggugccuggacauuugccuugcuggacggggacuggggaugugggagggagcagacaggaggaaucaugucaggccugugugugaaaggaagcuccacugucacccuccaccucuucaccccccacucaccaguguccccuccacugucacauuguaacugaacuucaggauaauaaaguguuugccuccauggucuuugaauaaagccugaguaggaaggcggccgcucgagcaugcaucuaga

SEQ ID NO: 86 - RNA, 835 nt, Artificial Sequence
  Synthetic polynucleotide
acucaaucuaaauuaaaaaagaaagaaauuugaaaaaacuuucucuuugccauuucuucuucuucuuuuuuaacugaaagcugaauccuuccauuucuucugcacaucuacuugcuuaaauugugggcaaaagagaaaaagaaggauugaucagagcauugugcaauacaguuucauuaacuccuucccccgcucccccaaaaauuugaauuuuuuuuucaacacucuuacaccuguuauggaaaaugucaaccuuuguaagaaaaccaaaauaaaaauugaaaaauaaaaaccauaaacauuugcaccacuuguggcuuuugaauaucuuccacagagggaaguuuaaaacccaaacuuccaaagguuuaaacuaccucaaaacacuuucccaugagugugauccacauuguuaggugcugaccuagacagagaugaacugagguccuuguuuuguuuuguucauaauacaaaggugcuaauuaauaguauuucagauacuugaagaauguugauggugcuagaagaauuugagaagaaauacuccuguauugaguuguaucgugugguguauuuuuuaaaaaauuugauuuagcauucauauuuuccaucuuauucccaauuaaaaguaugcagauuauuugcccaaaucuucuucagauucagcauuuguucuuugccagucucauuuucaucuucuuccaugguuccacagaagcuuuguuucuugggcaagcagaaaaauuaaauuguaccuauuuuguauaugugagauguuuaaauaaauugugaaaaaaaugaaauaaagcauguuugguuuuccaaaagaacauau

SEQ ID NO: 87 - RNA, 297 nt, Artificial Sequence
  Synthetic polynucleotide
cgccgccgcccgggccccgcagucgagggucgugagcccaccccguccauggugcuaagcgggcccgggucccacacggccagcaccgcugcucacucggacgacgcccugggccugcaccucuccagcuccucccacgggguccccguagccccggcccccgcccagccccaggucuccccaggcccuccgcaggcugcccggccucccucccccugcagccaucccaaggcuccugaccuaccuggccccugagcucuggagcaagcccugacccaauaaaggcuuugaacccau

SEQ ID NO: 88 - RNA, 602 nt, Artificial Sequence
  Synthetic polynucleotide
ggggcuagagcccucuccgcacagcguggagacggggcaaggagggggguuauuaggauuggugguuuuguuuugcuuuguuuaaagccgugggaaaauggcacaacuuuaccucugugggagaugcaacacugagagccaaggggugggaguugggauaauuuuuauauaaaagaaguuuuuccacuuugaauugcuaaaaguggcauuuuuccuaugugcagucacuccucucauuucuaaaauagggacguggccaggcacgguggcucaugccuguaaucccagcacuuugggaggccgaggcaggcggcucacgaggucaggagaucgagacuauccuggcuaacacgguaaaacccugucucuacuaaaaguacaaaaaauuagcugggcgugguggugggcaccuguagucccagcuacucgggaggcugaggcaggagaaaggcaugaauccaagaggcagagcuugcagugagcugagaucacgccauugcacuccagccugggcaacaguguuaagacucugucucaaauauaaauaaauaaauaaauaaauaaauaaauaaauaaaaauaaagcgagauguugcccucaaa

SEQ ID NO: 89 - RNA, 785 nt, Artificial Sequence
  Synthetic polynucleotide
ggcccugccccgucggacugcccccagaaagccuccugcccccugccagugaaguccuucagugagccccuccccagccagcccuucccuggccccgccggauguauaaauguaaaaaugaaggaauuacauuuuauaugugagcgagcaagccggcaagcgagcacaguauuauuucuccauccccucccugccugcuccuuggcacccccaugcugccuucagggagacaggcagggagggcuuggggcugcaccuccuacccucccaccagaacgcaccccacugggagagcugguggugcagccuuccccucccuguauaagacacuuugccaaggcucuccccucucgccccaucccugcuugcccgcucccacagcuuccugagggcuaauucugggaagggagaguucuuugcugccccugucuggaagacguggcucugggugagguaggcgggaaaggauggaguguuuuaguucuugggggaggccaccccaaaccccagccccaacuccaggggcaccuaugagauggccaugcucaaccccccucccagacaggcccucccugucuccagggcccccaccgagguucccagggcuggagacuuccucugguaaacauuccuccagccuccccuccccuggggacgccaaggaggugggccacacccaggaagggaaagcgggcagccccguuuuggggacgugaacguuuuaauaauuuuugcugaauuccuuuacaacuaaauaacacagauauuguuauaaauaaaauugu

SEQ ID NO: 90 - RNA, 3001 nt, Artificial Sequence
  Synthetic polynucleotide
auauuaaggaucaagcuguuagcuaauaaugccaccucugcaguuuugggaacaggcaaauaaaguaucaguauacauggugauguacaucuguagcaaagcucuuggagaaaaugaagacugaagaaagcaaagcaaaaacuguauagagagauuuuucaaaagcaguaaucccucaauuuuaaaaaaggauugaaaauucuaaaugucuuucugugcauauuuuuuguguuaggaaucaaaaguauuuuauaaaaggagaaagaacagccucauuuuagauguaguccuguuggauuuuuuaugccuccucaguaaccagaaauguuuuaaaaaacuaaguguuuaggauuucaagacaacauuauacauggcucugaaauaucugacacaauguaaacauugcaggcaccugcauuuuauguuuuuuuuuucaacaaaugugacuaauuugaaacuuuuaugaacuucugagcuguccccuugcaauucaaccgcaguuugaauuaaucauaucaaaucaguuuuaauuuuuuaaauuguacuucagagucuauauuucaagggcacauuuucucacuacuauuuuaauacauuaaaggacuaaauaaucuuucagagaugcuggaaacaaaucauuugcuuuauauguuucauuagaauaccaaugaaacauacaacuugaaaauuaguaauaguauuuuugaagaucccauuucuaauuggagaucucuuuaauuucgaucaacuuauaauguguaguacuauauuaagugcacuugaguggaauucaacauuugacuaauaaaaugaguucaucauguuggcaagugauguggcaauuaucucuggugacaaaagaguaaaaucaaauauuucugccuguuacaaauaucaaggaagaccugcuacuaugaaauagaugacauuaaucugucuucacuguuuauaauacggauggauuuuuuuucaaaucaguguguguuuugaggucuuauguaauugaugacauuugagagaaaugguggcuuuuuuuagcuaccucuuuguucauuuaagcaccaguaaagaucaugucuuuuuauagaaguguagauuuucuuugugacuuugcuaucgugccuaaagcucuaaauauaggugaaugugugaugaauacucagauuauuugucucucuauauaauuaguuugguacuaaguuucucaaaaaauuauuaacacaugaaagacaaucucuaaaccagaaaaagaaguaguacaaauuuuguuacuguaaugcucgcguuuagugaguuuaaaacacacaguaucuuuugguuuuauaaucaguuucuauuuugcugugccugagauuaagaucuguguaugugugugugugugugugugcguuuguguguuaaagcagaaaagacuuuuuuaaaaguuuuaagugauaaaugcaauuuguuaauugaucuuagaucacuaguaaacucagggcugaauuauaccauguauauucuauuagaagaaaguaaacaccaucuuuauuccugcccuuuuucuucucucaaaguaguuguaguuauaucuagaaagaagcaauuuugauuucuugaaaagguaguuccugcacucaguuuaaacuaaaaauaaucauacuuggauuuuauuuauuuuugucauaguaaaaauuuuaauuuauauauauuuuuauuuaguauuaucuuauucuuugcuauuugccaauccuuugucaucaauuguguuaaaugaauugaaaauucaugcccuguucauuuuauuuuacuuuauugguuaggauauuuaaaggauuuuuguauauauaauuucuuaaauuaauauuccaaaagguuaguggacuuagauuauaaauuauggcaaaaaucuaaaaacaacaaaaaugauuuuuauacauucuauuucauuauuccucuuuuuccaauaagucauacaauugguagauaugacuuauuuuauuuuuguauuauucacuauaucuuuaugauauuuaaguauaaauaauuaaaaaaauuuauuguaccuuauagucugucaccaaaaaaaaaaaauuaucuguagguagugaaaugcuaauguugauuugucuuuaagggcuuguuaacuauccuuuauuuucucauuugucuuaaauuaggaguuuguguuuaaauuacucaucuaagcaaaaaauguauauaaaucccauuacuggguauauacccaaaggauuauaaaucaugcugcuauaaagacacaugcacacguauguuuauugcagcacuauucacaauagcaaagacuuggaaccaacccaaauguccaucaaugauagacuugauuaagaaaaugugcacauauacaccauggaauacuaugcagccauaaaaaaggaugaguucauguccuuuguagggacauggauaaagcuggaaaccaucauucugagcaaacuauugcaaggacagaaaaccaaacacugcauguucucacucauaggugggaauugaacaaugagaacacuuggacacaagguggggaacaccacacaccagggccugucaugggguggggggaguggggagggauagcauuaggagauauaccuaauguaaaugaugaguuaaugggugcagcacaccaacauggcacauguauacauauguagcaaaccugcacguugugcacauguacccuagaacuuaaaguauaauuaaaaaaaaaaagaaaacagaagcuauuuauaaagaaguuauuugcugaaauaaaugugaucuuucccauuaaaaaaauaaagaaauuuugggguaaaaaaacacaauauauuguauucuugaaaaauucuaagagaguggaugugaaguguucucaccacaaaagugauaacuaauugagguaaugcacauauuaauuagaaagauuuugucauuccacaauguauauauacuuaaaaauauguuauacacaauaaauacauacauuaaaaaauaaguaaaugua

SEQ ID NO: 91 - RNA, 1037 nt, Artificial Sequence
  Synthetic polynucleotide
cccacccugcacgccggcaccaaacccuguccucccaccccuccccacucaucacuaaacagaguaaaaugugaugcgaauuuucccgaccaaccugauucgcuagauuuuuuuuaaggaaaagcuuggaaagccaggacacaacgcugcugccugcuuugugcaggguccuccggggcucagcccugaguuggcaucaccugcgcagggcccucuggggcucagcccugagcuagugucaccugcacagggcccucugaggcucagcccugagcuggcgucaccugugcagggcccucuggggcucagcccugagcuggccucaccuggguuccccaccccgggcucuccugcccugcccuccugcccgcccucccuccugccugcgcagcuccuucccuaggcaccucugugcugcaucccaccagccugagcaagacgcccucucggggccugugccgcacuagccucccucuccucuguccccauagcugguuuuucccaccaauccucaccuaacaguuacuuuacaauuaaacucaaagcaagcucuucuccucagcuuggggcagccauuggccucugucucguuuugggaaaccaaggucaggaggccguugcagacauaaaucucggcgacucggccccgucuccugaggguccugcuggugaccggccuggaccuuggcccuacagcccuggaggccgcugcugaccagcacugaccccgaccucagagaguacucgcaggggcgcuggcugcacucaagacccucgagauuaacggugcuaaccccgucugcuccucccucccgcagagacuggggccuggacuggacaugagagccccuuggugccacagagggcugugucuuacuagaaacaacgcaaaccucuccuuccucagaauagugauguguucgacguuuuaucaaaggcccccuuucuauguucauguuaguuuugcuccuucuguguuuuuuucugaaccauauccauguugcugacuuuuccaaauaaagguuuucacuccucuc

SEQ ID NO: 92 - RNA, 577 nt, Artificial Sequence
  Synthetic polynucleotide
agaggccugccuccagggcuggacugaggccugagcgcuccugccgcagagcuggccgcgccaaauaaugucucugugagacucgagaacuuucauuuuuuuccaggcugguucggauuugggguggauuuugguuuuguuccccuccuccacucucccccacccccuccccgcccuuuuuuuuuuuuuuuuuuaaacugguauuuuaucuuugauucuccuucagcccucaccccugguucucaucuuucuugaucaacaucuuuucuugccucuguccccuucucucaucucuuagcuccccuccaaccuggggggcagugguguggagaagccacaggccugagauuucaucugcucuccuuccuggagcccagaggagggcagcagaaggggguggugucuccaaccccccagcacugaggaagaacggggcucuucucauuucaccccucccuuucuccccugcccccaggacugggccacuucuggguggggcagugggucccagauuggcucacacugagaauguaagaacuacaaacaaaauuucuauuaaauuaaauuuugugucucc

SEQ ID NO: 93 - RNA, 2212 nt, Artificial Sequence
  Synthetic polynucleotide
cucccuccaucccaaccuggcucccucccacccaaccaacuuuccccccaacccggaaacagacaagcaacccaaacugaacccccucaaaagccaaaaaaugggagacaauuucacauggacuuuggaaaauauuuuuuuccuuugcauucaucucucaaacuuaguuuuuaucuuugaccaaccgaacaugaccaaaaaccaaaagugcauucaaccuuaccaaaaaaaaaaaaaaaaaaagaauaaauaaauaacuuuuuaaaaaaggaagcuugguccacuugcuugaagacccaugcggggguaagucccuuucugcccguugggcuuaugaaaccccaaugcugcccuuucugcuccuuucuccacaccccccuuggggccuccccuccacuccuucccaaaucugucuccccagaagacacaggaaacaauguauugucugcccagcaaucaaaggcaaugcucaaacacccaaguggcccccacccucagcccgcuccugcccgcccagcacccccaggcccugggggaccugggguucucagacugccaaagaagccuugccaucuggcgcucccauggcucuugcaacaucuccccuucguuuuugagggggucaugccgggggagccaccagccccucacuggguucggaggagagucaggaagggccacgacaaagcagaaacaucggauuuggggaacgcgugucaaucccuugugccgcagggcugggcgggagagacuguucuguuccuuguguaacuguguugcugaaagacuaccucguucuugucuugaugugucaccggggcaacugccugggggcggggaugggggcaggguggaagcggcuccccauuuuauaccaaaggugcuacaucuaugugaugggugggguggggagggaaucacuggugcuauagaaauugagaugcccccccaggccagcaaauguuccuuuuuguucaaagucuauuuuuauuccuugauauuuuucuuuuuuuuuuuuuuuuuuuguggauggggacuugugaauuuuucuaaaggugcuauuuaacaugggaggagagcgugugcggcuccagcccagcccgcugcucacuuuccacccucucuccaccugccucuggcuucucaggccucugcucuccgaccucucuccucugaaacccuccuccacagcugcagcccauccucccggcucccuccuagucuguccugcguccucuguccccggguuucagagacaacuucccaaagcacaaagcaguuuuucccccuaggggugggaggaagcaaaagacucuguaccuauuuuguauguguauaauaauuugagauguuuuuaauuauuuugauugcuggaauaaagcauguggaaaugacccaaacauaauccgcaguggccuccuaauuuccuucuuuggaguugggggagggguagacauggggaaggggcuuuggggugaugggcuugccuuccauuccugcccuuucccuccccacuauucucuucuagaucccuccauaaccccacuccccuuucucucacccuucuuauaccgcaaaccuuucuacuuccucuuucauuuucuauucuugcaauuuccuugcaccuuuuccaaauccucuucuccccugcaauaccauacaggcaauccacgugcacaacacacacacacacucuucacaucugggguuguccaaaccucauacccacuccccuucaagcccauccacucuccacccccuggaugcccugcacuugguggcggugggaugcucauggauacugggagggugaggggaguggaacccgugaggaggaccugggggccucuccuugaacugacaugaagggucaucuggccucugcucccuucucacccacgcugaccuccugccgaaggagcaacgcaacaggagaggggucugcugagccuggcgagggucugggagggaccaggaggaaggcgugcucccugcucgcuguccuggcccugggggagugagggagacagacaccugggagagcuguggggaaggcacucgcaccgugcucuugggaaggaaggagaccuggcccugcucaccacggacugggugccucgaccuccugaauccccagaacacaaccccccugggcugggguggucuggggaaccaucgugcccccgccucccgccuacuccuuuuuaagcuu

SEQ ID NO: 94 - RNA, 729 nt, Artificial Sequence
  Synthetic polynucleotide
uuggccaggccugacccucuuggaccuuucuucuuugccgacaaccacugcccagcagccucugggaccucggggucccagggaacccaguccagccuccuggcuguugacuucccauugcucuuggagccaccaaucaaagagauucaaagagauuccugcaggccagaggcggaacacaccuuuauggcuggggcucuccgugguguucuggacccagccccuggagacaccauucacuuuuacugcuuuguagugacucgugcucuccaaccugucuuccugaaaaaccaaggcccccuucccccaccucuuccauggggugagacuugagcagaacaggggcuuccccaaguugcccagaaagacugucugggugagaagccauggccagagcuucucccaggcacagguguugcaccagggacuucugcuucaaguuuugggguaaagacaccuggaucagacuccaagggcugcccugagucugggacuucugccuccauggcuggucaugagagcaaaccguaguccccuggagacagcgacuccagagaaccucuugggagacagaagaggcaucugugcacagcucgaucuucuacuugccuguggggaggggagugacagguccacacaccacacugggucacccuguccuggaugccucugaagagagggacagaccgucagaaacuggagaguuucuauuaaaggucauuuaaacca

SEQ ID NO: 95 - RNA, 847 nt, Artificial Sequence
  Synthetic polynucleotide
uccuccgggaccccagcccucaggauuccugaugcuccaaggcgacugaugggcgcuggaugaaguggcacagucagcuucccugggggcuggugucauguugggcuccuggggcgggggcacggccuggcauuucacgcauugcugccaccccagguccaccugucuccacuuucacagccuccaagucuguggcucuucccuucuguccuccgaggggcuugccuucucucguguccagugaggugcucagugaucggcuuaacuuagagaagcccgcccccuccccuucuccgucugucccaagagggucugcucugagccugcguuccuagguggcucggccucagcugccuggguuguggccgcccuagcauccuguaugcccacagcuacuggaauccccgcugcugcuccgggccaagcuucugguugauuaaugagggcaugggguggucccucaagaccuuccccuaccuuuuguggaaccagugaugccucaaagacaguguccccuccacagcugggugccaggggcaggggauccucaguauagccggugaacccugauaccaggagccugggccucccugaaccccuggcuuccagccaucucaucgccagccuccuccuggaccucuuggcccccagccccuuccccacacagccccagaagggucccagagcugaccccacuccaggaccuaggcccagccccucagccucaucuggagccccugaagaccagucccacccaccuuucuggccucaucugacacugcuccgcauccugcuguguguccuguuccauguuccgguuccauccaaauacacuuucuggaacaaa

SEQ ID NO: 96 - RNA, 110 nt, Artificial Sequence
  Synthetic polynucleotide
gcuggagccucgguggccaugcuucuugccccuugggccuccccccagccccuccuccccuuccugcacccguacccccguggucuuugaauaaagucugagugggcggc

SEQ ID NO: 97 - RNA, 119 nt, Artificial Sequence
  Synthetic polynucleotide
ugauaauaggcuggagccucgguggccuagcuucuugccccuugggccuccccccagccccuccuccccuuccugcacccguacccccguggucuuugaauaaagucugagugggcggc

SEQ ID NO: 98 - RNA, 87 nt, Artificial Sequence
  Synthetic polynucleotide
gacagugcagucacccauaaaguagaaagcacuacuaacagcacuggaggguguaguguuuccuacuuuauggaugaguguacugug

SEQ ID NO: 99 - RNA, 23 nt, Artificial Sequence
  Synthetic polynucleotide
uguaguguuuccuacuuuaugga

SEQ ID NO: 100 - RNA, 23 nt, Artificial Sequence
  Synthetic polynucleotide
uccauaaaguaggaaacacuaca

SEQ ID NO: 101 - RNA, 21 nt, Artificial Sequence
  Synthetic polynucleotide
cauaaaguagaaagcacuacu

SEQ ID NO: 102 - RNA, 21 nt, Artificial Sequence
  Synthetic polynucleotide
aguagugcuuucuacuuuaug

SEQ ID NO: 103 - DNA, 92 bp, Artificial Sequence
  Synthetic polynucleotide
tcaagcttttggaccctcgtacagaagctaatacgactcactatagggaaataagagagaaaagaagagtaagaagaaatataagagccacc

SEQ ID NO: 104 - DNA, 119 bp, Artificial Sequence
  Synthetic polynucleotide
tgataataggctggagcctcggtggccatgcttcttgccccttgggcctccccccagcccctcctccccttcctgcacccgtacccccgtggtctttgaataaagtctgagtgggcggc

SEQ ID NO: 105 - DNA, 18 bp, Artificial Sequence
  Synthetic polynucleotide
attgggcacccgtaaggg

SEQ ID NO: 106 - RNA, 4440 nt, Artificial Sequence
  Synthetic polynucleotide
augcagaggagcccccucgaaaaggccagcguggucagcaagcuguucuucuccuggacccggcccauucuccggaagggcuacaggcagaggcuggagcugagcgauaucuaccagauccccagcguggauagcgccgauaaccugagcgaaaagcucgaacgggagugggacagggagcuggccagcaaaaagaaccccaaacugaucaacgccuugaggaggugcuucuucuggcguuucauguucuacggcaucuuccuguaccugggugagguaaccaaggccguccagccccugcugcugggccguaucaucgccagcuaugauccagacaauaaggaggagaggagcaucgccauauaccugggcaucgggcucugccuccuguucaucguccgaacccugcugcugcacccugccaucuuugggcugcaccacaucggcaugcagaugaggaucgccauguuuucccugaucuacaagaagacccugaagcuguccucacgggugcuggauaagaucagcaucggccagcuggugucccugcugagcaacaaccugaacaaguucgaugagggucuggcgcuggcccacuucguguggaucgccccccugcagguggcccugcuaaugggccugaucugggagcugcugcaggccagcgccuucugcggccugggcuuccugaucgugcuggcccuguuccaggccgggcugggcaggaugaugaugaaguacagggaccagagggcaggcaagaucuccgagcggcuggugaucaccuccgagaugaucgagaacauccagagcgucaaggccuacugcugggaggaggccauggagaagaugaucgagaaccugaggcagacugagcugaaacugaccaggaaggccgccuaugugagguacuuuaacagcagcgccuucuuuuucagcggguucuucgucguauuccucagcguacugcccuacgcccucaucaaggggaucauccuccggaagaucuucacaaccaucuccuucugcauugugcugcggauggccgugacccggcaguucccgugggccgugcagacgugguacgacucacugggcgccaucaacaagauccaggauuuucuacagaagcaggaguacaaaacccuggaguacaaccucacgacgaccgagguggugauggagaacgugaccgccuucugggaggagggcuucggagagcuguucgagaaggccaagcaaaauaacaacaacaggaaaaccagcaauggcgacgacucccuguuuuuuuccaacuuuagucugcugggcaccccaguacugaaggacaucaacuucaagaucgagcgaggccagcuccuggccguggccgggagcaccggcgccggaaagaccucccugcugauggugaucaugggcgagcucgagccguccgagggcaagaucaagcacagcggccggaucagcuucugcagccaauucagcuggaucaugcccggcaccaucaaggagaauaucaucuucggggugagcuaugacgaguacagguaccggagcguaaucaaagcgugccagcuggaggaggacaucuccaaguuugccgagaaggacaauaucgugcugggcgaggguggcaucacccucagcggcggccagcgggccaggaucagccuggcccgggccguguacaaggacgcugaucucuaccugcuggacagcccauucggcuaccuggacgugcugaccgagaaggaaauuuucgaguccugcgugugcaagcugauggccaacaaaaccaggauccuggugaccagcaaaauggagcaucugaagaaggccgacaagauccucauccugcaugaaggcagcuccuacuucuacgguaccuucuccgagcuccagaaccuccagcccgacuuuagcagcaagcucaugggcugcgacagcuucgaucaguucagcgccgagaggaggaacuccauucugaccgaaaccuugcauagguuuucccuggagggcgaugcccccgugagcuggaccgagaccaagaaacagagcuucaagcagaccggcgaauuuggggagaagaggaagaacuccauccugaaucccauaaacagcaucaggaaauucagcaucgugcaaaaaaccccccuccagaugaaugggaucgaggaggacucggaugagccccucgagcggaggcugagccuggugccagacuccgagcagggcgaggcaauccugcccaggaucagcguuaucagcaccgggccgacccugcaggccaggcgccggcaaagcgugcucaaccugaugacccacuccgucaaccagggccagaauauccaccgcaagaccaccgccagcaccaggaaggugagccuggccccgcaggccaaccuaaccgagcuggacaucuacucccggcggcugagccaggaaacgggccuggagaucagcgaagagaucaacgaggaggaccugaaggaguguuucuucgacgauauggagagcauccccgccgugaccaccuggaacaccuaucugcgguauaucaccgugcauaaguccuuaaucuucgugcugaucuggugccuggugaucuuccuggcggagguggccgccagccugguggugcuguggcugcuggggaacacgccccugcaggauaagggcaacagcacccacagcaggaacaauagcuacgcgguaaucaucaccagcacauccagcuacuacgucuucuacaucuacgugggcguagccgacacccuccuggccaugggguucuuccgcgggcugccccuggugcacacccucaucaccgugagcaaaauccugcaccauaagaugcugcauuccgugcuccaggcccccaugagcacccugaacacccugaaggcgggcggaauccucaaccgguucagcaaggacaucgccauccuggacgaccugcugccccucaccaucuucgacuuuauccagcugcugcugaucgucaucggggccauagccgugguggccguucugcagccuuacaucuucguggccaccguccccgugaucguggccuucaucaugcugcgggccuacuuccugcaaaccucccagcagcugaagcagcuggaaagcgagggccggucaccgaucuucacccaucuggucaccagccugaaaggccuguggacccugagggccuucggccggcagcccuacuucgagaccuuguuccacaaggcgcugaaccugcacaccgccaacugguuucuguaccugagcacccugcggugguuccagaugaggaucgagaugaucuucgugaucuucuucauagccgugaccuucaucagcauacugaccaccggggaaggcgagggcagggucggcaucauccucacccuggccaugaacaucaugagcacccugcagugggcggugaacagcuccaucgauguggacagccugaugagguccgugagucggguguucaaguucaucgacaugcccaccgagggcaaaccuaccaaauccaccaaacccuacaagaacgggcaacugagcaaggugaugauaaucgagaacagccacgugaagaaggacgacaucuggcccuccggcgggcagaugaccgugaaagaccugaccgccaaguacaccgagggcggcaaugccauccuggagaacaucagcuucagcaucuccccgggucagagggugggccugcuggggcgcaccggcuccggcaagagcacccugcugagcgcguuccugagacugcugaacaccgagggcgagauucaaaucgacggugugagcugggauagcaucacgcugcagcaguggaggaaggcauucggggugaucccgcaaaaaguauucauauucagcggcaccuuucgcaagaaccuggaccccuacgagcagugguccgaccaggagauauggaagguugccgacgaggugggccugagaagcgugauagaacaauuccccggcaagcuggauuucgugcucguggaugggggcuguguccucucucacggccacaagcagcugaugugccuggcccggagcgugcuguccaaggcaaagauccugcugcuggacgagcccagcgcacaccucgaccccgugacuuaccagaucauaaggcguacgcugaagcaggccuucgccgacugcaccgugauccucugcgagcauaggaucgaggccaugcuggagugccagcaguuccucgugauagaggagaacaaagucaggcaauacgacuccauccagaagcugcucaaugagagaucccuguuccggcaggccaucagcccgagcgacagggugaagcuguucccccaucgaaacagcuccaagugcaaguccaagccccagaucgcggcucugaaggaggagacggaggaagaggugcaggauaccaggcug

SEQ ID NO: 107 - RNA, 4440 nt, Artificial Sequence
  Synthetic polynucleotide
augcagaggagcccccuggagaaagccagcguggucagcaagcuguuuuuuagcuggaccaggccgauccugcgcaagggcuacaggcagaggcuggaacugagcgacauauaccagauccccagcguggacagcgccgacaaccugagcgagaagcucgagcgcgagugggaccgggagcuggccagcaagaagaacccgaagcugaucaacgcccucaggcgcugcuucuucuggcgguucauguucuacggcaucuuccuguaccucggggaggugacaaaggccguucagccgcugcugcugggccguaucaucgcgagcuacgaccccgacaacaaggaggaaagguccaucgccaucuaucugggcaucggccugugucuccuuuucaucgugaggacccugcuccugcaccccgccaucuucggccugcaucacauuggcaugcagaugaggauagcgauguucagccugauauacaagaaaacacugaagcucuccuccaggguccuggacaagaucagcaucgggcagcuggugucccugcugagcaacaaccugaacaaguucgacgagggccucgcccuggcccacuucgucuggaucgccccccugcaaguggcccugcugaugggccugaucugggagcugcuccaggcgagcgccuuuugcgggcugggcuuccugaucgugcuggcccuauuccaggcgggccugggcaggaugaugaugaaguacagggaccagagggccggcaagauauccgagaggcucgugaucaccagcgagaugaucgagaauauccagucggugaaggccuacugcugggaggaggccauggagaagaugaucgagaaccugaggcagaccgagcugaagcucaccagaaaggccgcauacgucagguacuucaacagcuccgccuucuucuucagcggcuucuucgugguguuccuguccgugcugcccuaugcgcugaucaagggaaucauccugcggaaaaucuuuaccaccaucuccuucugcaucgugcugaggauggccgugacccgccaguuccccugggcggugcaaaccugguacgacagccugggggccaucaacaagauccaggacuuccugcaaaagcaagaguacaagacccuggaauacaaccugaccaccaccgaagucgucauggagaaugugaccgccuucugggaggaggguuucggcgagcuguuugaaaaagccaagcagaacaacaacaaccguaagaccuccaacggugacgacagccucuuuuucuccaacuucagccugcucggcacucccguccugaaggacaucaauuucaagauugaacgggggcagcuccuggccguggccgggagcaccggagccgggaagaccagccugcugauggucaucaugggcgaacuggagcccuccgagggcaaaaucaagcacagcggcaggaucagcuucugcagccaguucagcuggaucaugccuggcaccaucaaggagaacaucaucuucggcgugagcuacgacgaguaccgguacagaagcgugaucaaagccugccagcucgaagaggacaucagcaaguucgcggaaaaggacaauaucgugcugggcgagggcggcaucacccugagcggcggccagcgggcucggaucucccucgccagggccguguacaaggacgccgaccucuaucugcuggacagccccuucgguuaccuggauguccugaccgagaaggaaaucuucgagagcugcgucuguaagcugauggccaacaagacucgcauacuggugaccagcaagauggagcaccugaagaaggcggacaagauccugauccugcacgagggcagcagcuacuucuacggcaccuucagcgaacugcagaaucugcagcccgacuucuccuccaagcugaugggcugcgacuccuucgaucaguucagcgccgaaaggcguaauagcauccucacagagacccuccaucgcuucagccuggagggcgacgcccccgucagcuggaccgagacgaagaagcagagcuucaagcagaccggcgaguucggcgagaagcggaagaacuccauccucaacccgaucaacagcauccgcaaguucagcaucgugcagaagaccccccugcagaugaacggcauagaggaggacuccgaugaaccccuggagaggaggcugagccuggugccugacucugaacagggggaggcgauccugccuagaauauccgucauauccaccggccccacccugcaggcaaggaggcgacagagugugcugaaucucaugacccacagugugaaccagggacagaacauccaucgcaagaccaccgccuccacccguaaggugucgcuggccccccaggccaaccucacggaacuggauaucuacucucgaaggcugagccaggagaccggucucgaaaucuccgaggagauuaacgaggaggaccucaaggaguguuuuuucgaugauauggaguccauccccgccgugaccaccuggaacaccuaucugcguuauaucaccgugcacaagagccugaucuucgugcugauauggugccuggugaucuuccucgccgagguggccgccucccuggucgugcucuggcugcuggguaacaccccccugcaagacaagggcaacuccacacacagccggaacaacagcuacgccgugaucaucaccuccaccagcagcuacuauguguucuacaucuacgucggcguggccgacacccugcuggccaugggcuucuuucgcgggcugccgcuugugcacacccugaucaccgugagcaagauccugcaccacaagaugcugcacuccgugcuacaggcgcccaugagcacccugaacacgcugaaagccggaggcauccugaauagguucucaaaggauaucgccauccuggacgaccugcucccccugaccaucuucgauuucauucagcuacugcuuauagugaucggggccaucgccguggucgccguccuccaacccuacaucuucguggcgaccgugcccgugaucgucgccuucaucaugcugagggccuacuuucuacagaccucccaacagcuuaagcagcuggagagcgagggccgcagcccgaucuucacccaccuggucaccagccugaagggccucuggacccugagggccuucggcaggcaaccuuacuucgagacccuguuccacaaggcccugaaucuccacaccgccaacugguuccucuaucucagcacccugaggugguuccagaugaggaucgagaugaucuuugugaucuucuucaucgccgucaccuucaucagcauccugaccacuggcgagggugaggggcgcgugggcaucauccucacccuggccaugaacauaaugagcacccugcagugggccgugaauagcagcaucgacguggacucacugaugcgguccgucuccagggucuucaaguuuaucgacaugcccaccgagggaaagcccaccaagagcaccaagccguacaagaacggccagcugagcaaggugaugaucaucgagaacagccauguaaagaaagacgacaucuggccuuccggcgggcagaugaccgugaaagaccugaccgccaaguauaccgaaggcggcaacgccauccuggagaacauaagcuuuagcaucagccccggccagagggugggucugcugggccgcacgggcagcggaaaaagcacccuccuguccgcguuccugcggcugcugaauaccgagggcgagauccagaucgacggagucagcugggacuccaucacccugcagcaguggaggaaggccuuuggugugaucccccagaagguguucaucuucagcggcaccuuucgcaagaaccuggaccccuaugagcaauggagcgaccaggagaucuggaagguggccgaugagguggggcugaggagcguaaucgagcaguuccccggcaaacuagacuucgugcugguggacggagggugcgugcucagccacggacacaaacagcugaugugccuggccaggagcguccucagcaaggccaagauacugcugcuggacgagcccuccgcccaccuggaccccguuacguaccagaucaucaggaggacccugaagcaggccuucgccgacugcaccgugauccugugcgagcacaggaucgaggccaugcuggagugucagcaguuccuugucaucgaggagaauaaagugaggcaguacgacuccauccagaagcugcugaacgagcggucacuguuucggcaagccaucagccccuccgaccgcgugaagcuguucccccaccgcaauagcagcaaaugcaaauccaaaccccagaucgccgcccugaaggaggagaccgaggaggagguccaagauaccaggcug

SEQ ID NO: 108 - RNA, 4440 nt, Artificial Sequence
  Synthetic polynucleotide
augcaacgcucgccccuggagaaggccagcguggugagcaagcuguuuuucuccuggacgaggcccauccugcggaaaggcuaccgccagcggcuggagcugagcgacaucuaucagauccccucgguggacagcgcugacaaccucuccgagaagcuggagcgagagugggauagggagcuggccagcaagaagaacccaaagcugaucaacgcccugcgcaggugcuuuuuuuggagguucauguucuacggcaucuuccuguaccuaggcgaagugaccaaggccgugcagccccugcugcugggucgcaucaucgccagcuacgaccccgauaacaaggaggagcgaagcaucgcgaucuaccugggcaucggccugugccugcuguucaucgugaggacccugcugcugcaccccgcgaucuucggccugcaccacaucggcaugcagaugaggaucgccauguucucccugaucuacaagaagacccucaagcucagcagccgggugcuggacaagaucuccauaggucagcucgugagccugcuguccaauaaccugaacaaguucgacgaaggccucgcgcuggcgcauuucguguggaucgccccgcugcagguggcucugcuuaugggccugaucugggagcugcugcaggccagcgccuucugcggccucggguuccugaucgugcuggcccuguuccaagccggccucggcaggaugaugaugaaauacagggaucagagggccggcaagaucucagagaggcuggugaucaccuccgagaugaucgaaaauauccaguccgugaaggcguauuguugggaagaggcaauggagaaaaugaucgagaaccugcggcagacggagcugaagcugacucggaaggcagccuaugugcgguauuuuaacagcagcgcguucuucuucagcggcuucuucgucguguuccucagcgugcugcccuacgcccugaucaaggguaucauacugaggaaaaucuucaccaccaucucauucugcaucgugcugcggauggccgugacccggcaguuuccgugggcggugcagaccugguacgacagccugggcgccaucaacaagauccaggacuuucuccagaagcaggaauacaagacccucgaauauaaccugaccaccaccgagguggugauggagaacgucaccgccuucugggaggaaggcuucggggagcucuucgagaaggccaagcagaauaacaacaaccggaaaaccagcaauggcgacgacagccuguucuucagcaacuuuucccuccugggcacccccgugcugaaggauaucaacuuuaagaucgagaggggccagcugcuggccguggccgggagcaccggcgccggcaaaacgagccugcugauggucaucaugggcgagcuggaacccagcgagggcaagauuaagcacuccggccggaucucuuucuguucccaguucagcuggaucaugcccggcaccaucaaggagaacauuaucuucggggugagcuacgacgaauaucgcuacagguccgugaucaaggcgugccaacuggaggaggacaucuccaaguuugccgagaaagacaacaucgugcucggcgaggggggcaucacguuaagcggcggccagagggccagaaucagccuggccagggcgguguacaaggaugccgaccucuaccugcuggacagccccuuuggcuaccuggacgugcucacggagaaggagaucuucgagagcugcguguguaagcugauggccaacaaaacgcgcauccuggugaccucgaagauggaacaccugaagaaggccgacaagauccugauacugcacgagggaagcuccuauuuuuacggcacuuuuagcgagcuccagaaccugcagcccgacuucagcagcaagcugaugggcugcgauagcuucgaccaguucuccgccgagaggcggaacagcauccugacagagacccugcacagguucagccucgagggggacgcccccgugagcuggaccgaaaccaaaaagcagagcuuuaagcagaccggcgaguucggcgaaaaacgaaagaacagcauccugaacccgaucaauagcauccguaaguucagcauagugcagaaaacccccuugcagaugaacggcauagaggaggauagcgacgaaccgcucgagaggaggcugagccuggucccagacagcgagcagggcgaggccauucuccccagaaucagcgugaucagcaccggccccacccuccaggcccgcaggaggcaguccgugcugaaccugaugacccacuccguaaaucaggggcaaaacauccaccggaagacgaccgccagcacccgaaaggugagccuggccccccaggccaaccugaccgagcucgacauuuauagcaggaggcugucccaggagacuggccucgagauuuccgaggaaaucaacgaggaagaccugaaggagugcuucuuugaugacauggagucgauccccgccgugaccaccuggaacacauaccugagguacaucaccgugcacaaaagccugaucuucguacucaucuggugccuggugaucuuucucgccgagguggccgccucgcuggugguccuguggcugcugggcaacaccccucugcaggacaaaggcaacuccacccacagcaggaacaauagcuacgcggugaucaucaccagcaccagcuccuacuacguguucuacaucuacgucggcguggccgacacccugcuggcgaugggcuucuucagggggcugccgcuggugcacacccugaucaccguguccaaaauccugcaccacaagaugcuccacucugugcugcaggcccccaugagcacccugaacacccugaaggccggcggcauccugaaccgguuuagcaaagacaucgccauccuggacgaccugcugccccucaccaucuucgacuucauucagcugcuccugaucgugaucggcgccaucgccgucguggccgugcuccagcccuacaucuucgucgccaccgugccggugaucguggccuucaucaugcugagggccuacuuccugcagacgagccagcagcugaagcagcuggaauccgaaggcaggagccccaucuucacccaccuggugacgucccucaagggccuguggacacugcgcgccuucggcaggcagccguacuucgagacccuguuccacaaggcccugaacuuacacaccgcgaauugguuccuguaccuguccacccugcggugguuccagaugcggauugagaugaucuucgugaucuucuuuaucgccgugacguuuauauccauccugacgaccggggagggggaaggcaggguggggaucauccucacccuggccaugaacaucaugagcacccugcagugggcggugaacuccagcaucgacguggacagccugaugcgaucagucagccggguauucaaguucaucgauaugccgaccgaggggaagcccaccaagagcaccaagcccuacaagaacgggcagcuguccaaggugaugaucaucgagaacagccacgugaagaaggacgacaucuggcccuccggcggucagaugaccgugaaggaccugaccgccaaguacaccgaaggcggcaacgccauccuggagaacaucagcuucuccaucagcccggggcaaaggguggggcugcuggggaggaccggcagcggcaaaagcacgcugcugucugccuuccugaggcuccugaacaccgagggcgagauccagaucgacggcguguccugggacagcaucacccugcagcaguggcggaaggccuuuggcgugaucccgcaaaaggucuucaucuucagcgguacguuuaggaagaaucuggaccccuaugagcaguggucggaucaggagauuuggaagguggccgacgaggugggccugaggagcgugaucgagcaguuccccggaaaacuggauuucgugcugguggauggcggcugcguccugucccacggccacaaacagcugaugugucuggcccgcagcguccuguccaaggccaagauccugcugcuggacgagccgagcgcucaucucgauccugucaccuaccagaucauccggaggacccugaaacaggcauucgccgacuguacggucauccugugugaacaccgaauagaagccaugcuggaaugccaacaguuccuggugaucgaggagaauaaggucaggcaguacgacuccauccagaagcugcugaaugagcgaucccuguuccggcaggccaucucccccuccgauagggugaagcuguuuccacaucggaacuccaguaaaugcaagagcaagccccagaucgccgcccugaaggaagagaccgaagaggaggugcaggacacccgacug

SEQ ID NO: 109 - RNA, 4440 nt, Artificial Sequence
  Synthetic polynucleotide
augcaaagguccccccuggagaaggccagcguggugagcaagcuguucuucagcuggacccgacccauccuccgcaagggcuacaggcaacguuuggagcugagcgauauuuaccagauccccucaguggauucggccgacaaccuguccgagaagcuggagagggagugggaucgggagcuggccagcaagaagaacccuaagcugaucaacgcccugaggcggugcuucuucuggagguucauguuuuacggcaucuuccuguaucugggcgaggugaccaaggccguacagccccugcugcuggggcggaucaucgccagcuacgacccggauaacaaagaggagaggagcaucgccaucuaucugggcaucggccugugccugcucuucaucgugaggaccuugcugcugcaccccgccaucuucggccugcaccacaucggcaugcagaugaggaucgcuauguucucccugaucuacaagaagacccugaaacugucgagcaggguccuggacaagauaucgaucgggcagcugguuagccugcuguccaacaaccugaauaaguucgacgagggccuggcgcuggcccacuucguguggaucgccccccugcaggucgcgcugcugaugggccugaucugggaacugcuacaagccuccgccuucugcggccugggcuuucugaucgugcuggcccuguuccaggccggccucggccggaugaugaugaaguacagggaccagcgggccggcaagaucagcgagcggcuggucaucacgagcgagaugaucgagaacauccagagcgugaaggccuacugcugggaggaagccauggaaaagaugaucgagaaccugcggcagacagaacugaagcugacccggaaggccgcguauguccgguacuucaauagcagcgccuucuucuucuccgguuucuucguggucuuccuguccgugcucccguacgcccugaucaagggcaucauccugaggaaaaucuucaccaccaucagcuucuguaucgugcugaggauggccgucaccaggcaguuucccugggccgugcagaccugguacgauagccugggcgccaucaacaagauccaagacuuccugcagaagcaggaauacaagacccucgaguacaaccugaccaccaccgagguggugauggagaacgugaccgccuucugggaggagggguucggcgagcuguuugagaaggccaaacagaauaacaacaacaggaagaccagcaacggcgaugacagccuguucuucucgaacuucagccugcugggcacccccgugcugaaggauaucaacuucaagaucgagaggggccagcugcuggccguggccgggagcaccggcgccggcaagaccagccugcugauggugaucaugggggagcuggagccgagcgaggguaagaucaagcacagcgggaggaucuccuuuugcucccaguucuccuggaucaugccgggcacgaucaaagagaacaucauauucggggugagcuacgacgaauacagguaccggagcgugaucaaggccugccagcuggaggaggacaucucaaaguucgccgagaaagacaacaucguucugggggagggcgggaucacccuguccggcgggcaacgggccaggaucagccuggcccgcgcggucuacaaggacgccgaccuguaccugcucgauagcccguucgguuaccuggauguccugaccgagaaggagaucuucgagagcugcgugugcaagcugauggccaacaagaccaggauccuggugaccaguaaaauggagcaccugaagaaagccgacaagauccugauccugcacgaggggagcagcuacuucuacggcaccuucagcgagcugcagaaccugcagccagacuuuucgagcaagcucaugggcugcgauagcuucgaccaguucagcgccgagaggaggaacuccauccugaccgaaacccuccacagguucucacuggagggcgaugcccccguguccuggaccgagaccaagaaacagagcuucaagcagaccggggaguucggcgaaaaacguaagaacagcauacugaacccaauaaauagcaucaggaaguucucgaucgugcagaagaccccccuccaaaugaacggcaucgaggaggacagcgacgagccccuggagcggcgccugagccuggugcccgacagcgaacaaggcgaggcgauccugcccaggaucagcguaaucagcaccggucccacccugcaggccaggaggcggcagagcgugcugaaccugaugacccauagcgugaaccagggccagaacauacaccggaagacgaccgccagcacccggaaggucagccuggccccccaagccaaccugaccgagcuggacaucuacagcaggcgucugagccaggagaccgggcuggagaucagcgaagagaucaacgaggaggaccugaaggagugcuuuuuugacgacauggagagcauccccgccgugaccaccuggaacaccuaccugcgcuacaucaccguccacaagucccucauauucguccugaucuggugccuggucaucuuccucgcagaaguggccgccagccugguggugcuguggcugcugggcaacaccccgcugcaagacaagggaaacagcacccacagcaggaacaacagcuacgccgugaucaucaccuccaccucgagcuacuacguguucuauaucuacgugggcguggccgacacccugcuggccauggguuucuucaggggccugccccucgugcacacccucauaacugucagcaagauccugcaccacaagaugcuccacagcguucugcaggcccccaugagcacccugaacacccugaaggccggcggcauccugaaccgguuuagcaaggacauagccauccucgaugaccugcugccccugaccaucuucgacuucauccagcuccugcugaucgugaucggcgccaucgccgugguggccgugcuccagcccuacaucuucgucgccacgguccccgugaucguggccuucaucaugcugcgcgccuacuuucuccagacaagccaacagcugaagcagcuggagagcgagggacggagccccaucuucacccaccucgugaccucccugaaaggccuguggacccugagggccuucggcaggcagccguauuuugaaacccucuuccacaaggccuugaaccugcauacugccaacugguuccuguaccugagcacccugcggugguuccagaugaggaucgagaugaucuucgugaucuucuucaucgccgugaccuuuaucagcauccugaccaccggcgagggugagggccggguggggaucauccucacccuggccaugaacauaauguccacccugcagugggccgugaacagcagcaucgacguggacagccugaugaggagcgugucccgggucuucaaguuuaucgacaugcccaccgagggcaagcccacgaagagcaccaagccuuacaaaaacggacagcuguccaaagugaugaucaucgagaacucccacgucaaaaaggacgacaucuggcccagcgguggccagaugaccguuaaggaccucaccgccaaguacaccgagggcggaaacgccauccuggagaacaucagcuucuccaucuccccgggacagcgcgugggccugcuggggcgcaccggcagcggaaagagcacccugcuguccgccuuccugcgccugcugaacaccgagggggagauccagauugacggcgugagcugggacagcaucacgcugcagcaguggcggaaggcuuucggggugaucccccagaagguguucaucuucuccggcaccuuccggaagaaucuggaccccuacgagcaguggagcgaccaggagaucuggaagguggccgaugagguggggcugcgguccgugaucgagcaguuccccggcaagcuggauuucguccugguggaugggggcugcgugcuuagccacggccacaagcagcugaugugccuggcgaggucagugcugagcaaggccaaaauccugcuccuggacgagccuagcgcgcaccuggaccccgugaccuaccaaaucaucaggaggacccugaaacaagccuucgccgacugcaccgugauccugugcgagcaccgcaucgaggccaugcuggaaugccagcaguuccuggugaucgaggagaauaagguccggcaguacgacucaauccagaagcugcucaacgagcguagccuguucaggcaagccaucucgcccagcgauagggugaagcuguuuccccaucgcaacagcuccaaguguaagagcaagccccagaucgccgcccugaaggaagagaccgaggaggaggugcaggacaccaggcuu

SEQ ID NO: 110 - RNA, 4440 nt, Artificial Sequence
  Synthetic polynucleotide
augcagagguccccccuggagaaggccagcguggugagcaagcucuuuuucagcuggacgaggcccauccugaggaagggguaccggcagaggcuggagcucagcgacaucuaucaaauccccagcguggacuccgccgacaaccugagcgagaagcucgagagggagugggauagggagcuggccagcaagaagaauccgaagcugaucaacgcccucaggcggugcuucuuuuggagguucauguucuacggcaucuuccuguaccugggcgaggugaccaaggccgugcagccgcugcugcugggccggaucaucgccagcuacgaccccgauaacaaggaggaacgguccaucgccaucuaccuggggaucggccugugccugcuguucaucgugagaacccuccuucugcaccccgccaucuucgggcugcaccacaucggaaugcagaugcggauugccauguucagccugaucuauaaaaaaacucugaagcucagcagcagggugcuggacaagauaagcaucggccagcuggugagccugcugagcaauaaccugaacaaauucgacgagggccuggcccuggcccacuucguguggaucgccccccugcaagucgcccugcugaugggccucaucugggaacuccugcaggccucugccuucugcgggcugggcuuccugaucgugcuggcccuguuucaagcugggcugggcaggaugaugaugaaguaccgcgaccagagggccgggaagaucagcgagcggcuggugaucaccagcgagaugaucgagaacauccaguccgucaaggccuacugcugggaggaggccauggagaagaugauugagaaucugaggcagaccgaacugaagcucacaaggaaggccgccuacgugagguacuucaauagcagcgccuuuuuuuuuagcggguucuucguggucuuccugagcgugcugcccuaugcccucaucaaaggaaucauccugcgcaagaucuucaccaccaucagcuucugcaucguccugaggauggccgugacgaggcaguuucccugggccgugcagaccugguacgacagccugggggccaucaauaagauccaggacuuccugcagaagcaggaguacaagacccuggaguacaaccugacaaccaccgagguggucauggagaacgugacggcauucugggaggaaggcuucggggagcucuucgagaaagcgaagcagaacaacaacaacaggaagacgagcaacggggacgacagccuguuuuucagcaauuuuucccugcugggcacgcccgugcugaaagauaucaacuucaagaucgagagggggcaacugcuggccguggccgggagcaccggcgccggcaagaccagccugcugauggugaucaugggcgagcucgagcccagcgaggggaagaucaagcacuccgggcggaucagcuucugcagccaguuuagcuggauaaugcccggcaccaucaaagagaacaucaucuucgggguguccuacgacgaguaccgguaccgcagcgugaucaaggccugucagcuggaggaggacaucuccaaguuugccgagaaggacaauaucgugcuaggcgagggcggaaucacgcuguccggcggccagcgggccaggaucagccuggccagggccgucuauaaggacgccgaccuguaccugcuggacagccccuucggguaccucgacgugcugaccgagaaggagaucuucgagucgugcgugugcaaacugauggccaacaagaccaggauccuggugaccuccaagauggagcaccugaagaaggcugacaagauccugauccuacaugaaggcuccagcuacuuuuacgggaccuucagcgaacugcagaaccugcaacccgacuucagcuccaagcugaugggaugcgacuccuuugaccaguucagcgccgagaggcgcaacagcauccugacagagacccugcaccgguucucccuugagggcgacgcgcccgucagcuggaccgagacgaagaagcagagcuucaaacagaccggcgaguucggcgagaagaggaagaauucaauccugaaccccaucaacagcaucaggaaauucagcaucguccagaagacaccccugcagaugaacggcaucgaggaggacagcgaugagccccuggaaaggcgucugagccuggugcccgacuccgagcagggcgaggccauccuccccaggaucagcgucaucagcaccggcccgacacugcaggcccggaggagacaaagugugcugaaccucaugacccacagcgugaaccagggacagaacauccauaggaagaccacugcgagcacccggaaggugucccuggccccccaggcaaaccugaccgagcuggacaucuacucccggcgccugagccaggaaaccgggcuggagauaagcgaggagaucaaugaggaggaucugaaggaguguuucuucgacgacauggagucgauccccgccgugaccaccuggaacacguaucugcgcuacaucaccgugcacaagagccugaucuucgugcucaucuggugcuuggugaucuuucuggccgaagucgccgccucccugguggugcuguggcugcucgguaacaccccccugcaggacaaggggaacagcacccacagccguaacaacuccuaugccgucauaaucaccuccaccagcagcuacuacgucuucuacauuuacguggggguggccgacacccugcuggccaugggguucuuccggggccugccgcuggugcacacccucauuaccgugucgaagauccugcaccacaagaugcugcacagcgugcugcaggcccccauguccacccugaacacccugaaggccggcgggauccucaaccgcuuuagcaaggacaucgccauccuggacgaccuccugccccugaccaucuucgacuucauccagcugcugcugaucgugaucggcgccaucgccguaguggcgguucuccagcccuacaucuucguggccaccgugccggugaucguggccuuuaucaugcugagggccuacuuccugcagaccagccagcaacugaagcagcucgagagcgagggccgcucccccaucuucacccaccuggugaccagccugaagggucucuggacgcugcgcgccuucggcaggcaacccuacuuugagacccuguuucacaaagcccugaaccugcacaccgccaacugguuucuguaccuguccacccugaggugguuccagaugcggaucgagaugaucuucgugaucuuuuucaucgccgugaccuucaucuccauccugaccaccggggaaggggagggacgggugggcaucauccugacccucgccaugaacaucaugagcacccuacagugggccgugaauagcuccaucgacgucgacagccucaugcguagcgugagcaggguguucaaauuuauagacaugcccaccgaggggaagcccaccaagagcaccaagcccuauaaaaaugggcaacuguccaaagucaugaucauagaaaacagccacgugaagaaagacgacaucuggcccagcggcggccagaugaccgucaaggaccugaccgccaaguacaccgagggaggcaaugccauccuggagaacaucagcuuuagcaucagccccggccagagagugggccuacugggccggaccggcagcggcaaguccacccugcugagcgccuuccugcgucugcugaauaccgagggcgaaauccagaucgacggcguguccugggacagcauaacccugcagcaauggcggaaggccuucggagugaucccccagaagguguucaucuucagcgggacguucaggaagaaccuggaccccuacgagcaauggagcgaccaggagauauggaagguggcggacgaggugggccugcggagcgucauagaacaguuccccggcaagcuggacuucguguuggucgacggcggguguguccugagccacggccacaagcagcucaugugccuggcccgcagcguccuguccaaagccaaaauacugcuccuggacgagccaagcgcccaccuggaccccgugaccuaccagaucauccggaggacccugaagcaggccuucgccgacugcaccgucauccugugcgaacacaggaucgaagccaugcuggagugccagcaguuccuggugaucgaagagaacaaggugcggcaguacgacagcauccagaagcugcugaaugaaagaucccuguucagacaggccaucagccccagcgacagggucaagcuguuuccccacaggaacagcuccaagugcaagucgaagccccagaucgcggcccugaaggaggagaccgaggaagaggugcaggacaccaggcug

SEQ ID NO: 111 - RNA, 4440 nt, Artificial Sequence
  Synthetic polynucleotide
augcagcggagcccccucgagaaggccagcguugucagcaagcuguuuuucagcuggacccgccccauccugagaaagggcuaccgccagcggcuggaacugagcgauaucuaccagauccccagcguggacagcgccgacaaccugagcgaaaaacuggaaagggagugggaccgggaacuggccagcaagaagaaucccaaacugaucaacgcccuccgucgcugcuucuucuggagguuuauguucuacgggauauuccuauaccugggggaagugaccaaggccgugcagccccuccugcugggcaggaucaucgccagcuaugaccccgacaacaaggaggaaagaagcauagccaucuaucuagggaucgggcucugccugcuguucaucgucagaacccugcugcuccaccccgccaucuucggccugcaccauaucggaaugcagaugcgcaucgcgauguucagccugaucuacaagaaaacccugaaacugagcagcaggguucuggacaagaucuccaucgggcagcuggugagccugcuguccaacaaccugaacaaauucgacgaggggcuggcccucgcacauuucguuuggaucgccccgcuccagguggcccugcugaugggccugauaugggagcugcugcaggccuccgccuucugcggccugggguuccucaucguccuggcccuguuccaggccgggcugggccgcaugaugaugaaguacagggaccagcgggccggcaaaaucagcgagagacuggucaucaccagcgagaugaucgagaauauccagagcgugaaagccuacugcugggaggaggccauggagaagaugaucgagaaccugcggcagacagaacugaagcugaccaggaaggccgccuacgugcgcuacuucaauuccuccgccuucuucuucagcggcuucuucgucguguuccugagcgugcugcccuacgcccugaucaaggggaucauacuccggaaaaucuucaccaccaucuccuucugcauaguucugcgcauggccgucaccaggcaguuucccugggccgugcagacgugguacgacucccugggcgccaucaacaagauccaagacuuccuccagaagcaggaguacaagacccuggaguacaaccugaccaccacggagguggugauggagaacgugaccgccuucugggaggagggcuucggcgagcuguucgaaaaggccaagcagaacaacaacaaccggaagaccagcaacggcgacgauucccuguucuucagcaacuucagccugcugggcaccccuguccucaaagacaucaacuucaagaucgagcgggggcagcuccuggccgucgccggaagcaccggcgcgggcaagaccagccuucuaauggugaucaugggugaacuggagcccagugagggaaagauaaagcacagcggccggauaagcuucugcucacaauucuccuggaucaugcccggcaccaucaaagagaacauaaucuuugguguguccuacgacgaguaccgguauaggagcgugauaaaggccugccagcuggaggaagauaucagcaaguucgcagaaaaagacaacaucguccugggggagggcgguauuacccuguccggcggccaacgggcccgcaucagcuuggcgagggccguguauaaagacgccgaucuguaccugcuggacagcccguucggauaccuggaugugcugaccgagaaggagaucuucgagagcugugugugcaagcugauggccaacaagacccgcauccuggugaccagcaaaauggagcaccucaagaaagccgacaaaauccucauccugcacgaggggagcagcuauuucuacggcaccuucuccgaacugcagaaccugcagcccgacuucagcagcaagcugaugggaugugauuccuucgaccaguucagcgcagaaaggaggaacuccauccugaccgagacccugcaccgcuucagucucgagggagaugcacccgugagcuggaccgagaccaagaagcaguccuucaagcagaccggugaauucggcgagaagcgcaaaaauuccauccucaaucccaucaacucgauccgaaaguucuccaucgugcagaagaccccccugcagaugaauggcaucgaggaggacagcgacgagccccuggaaaggaggcugagccuggugcccgacuccgagcaaggggaggccauccugcccaggaucuccgugaucagcaccggacccacacugcaggcccggaggaggcaaagcgugcugaaccucaugacccacuccgugaaccagggucagaacauccacaggaagaccaccgccagcacaaggaaagugucccuggccccccaagccaaccuuaccgagcuggacaucuauuccaggaggcucagccaggagaccgggcuagaaaucagcgaggaaaucaacgaggaggaccugaaggagugcuucuucgacgacauggagucaauccccgccgugaccaccuggaacaccuaccugagguacaucaccgugcacaagagccugaucuucgugcugaucuggugucuggucaucuuccuggccgagguggccgccagccuggucguccucuggcugcuggggaacaccccccuccaggauaaggggaauagcacccacagccggaacaacuccuacgccgugaucaucacauccaccuccuccuauuaugucuuuuacaucuacgucgggguggcggacacgcugcuggcaaugggcuucuuccggggucugccccuggugcauacccugaucaccguguccaagauucugcaccacaaaaugcugcacagcgugcuucaggccccgauguccacacucaacacccucaaggccgggggcauccugaaccgguuuuccaaggacaucgccaucuuggacgaccugcugccccugacgauuuuugauuucauccagcugcugcugaucgucauuggcgcgaucgccguggucgccguccugcaacccuauaucuucguggccaccgugccggucaucguggccuuuaucaugcugcgagccuacuuccugcagacgagccagcagcugaagcagcucgagucagagggcaggucccccaucuucacccaccuggugaccucccugaagggucucuggacccugcgcgcuuucgggaggcagcccuacuucgagacgcuguuccauaaagcccugaaccugcacaccgccaauugguuccucuaccucuccacccugcggugguuccagaugcgcaucgaaaugaucuucgugauuuucuucaucgccgugaccuuuaucuccauccucaccaccggagaaggggaaggccgggugggcaucauccugacacucgccaugaacauaaugagcacccugcagugggccgugaacagcagcaucgacguugacagccugaugagguccgugucccgggucuucaaguucaucgacaugccgaccgagggcaagcccaccaaaagcaccaaaccuuacaagaacgggcagcucagcaaggugaugaucaucgagaacagccacgugaagaaggacgacaucuggcccagcggagggcagaugacagugaaagaucuuaccgccaaguacaccgaaggcggcaaugccauccuggaaaauauaagcuucagcaucagccccggccagagggucggccugcugggcaggaccggauccgggaagagcacccugcuguccgccuuucugcgccugcugaacaccgagggggagauacaaaucgacggcguguccugggacagcaucacccugcagcaauggaggaaagccuucgggguuaucccccagaaaguguucauuuuuuccgggaccuucaggaaaaaccuggaccccuacgagcaguggagcgaccaggaaaucuggaagguggcggacgaggugggccucaggagcgugaucgagcaguuccccggcaagcuggacuucgugcugguggacggcggcugcgugcugagccacggccauaagcagcugaugugccuggccaggagcgugcuguccaaagccaagauccuccuccuggaugagccgagcgcccaucuggacccggugaccuaccagaucauccgaaggacucugaagcaggccuuugcggacugcaccgugauccugugcgagcacaggaucgaggcgaugcuggagugccagcaguuccuggugaucgaagagaacaaggugaggcaauacgacucgauccagaagcugcugaaugagaggucccuguuuaggcaggcaaucagccccagcgauagggugaagcuguucccacaccggaacuccucgaaguguaaguccaagccccaaauagccgcccucaaggaggagaccgaggaggaggugcaggacacccggcug

SEQ ID NO: 112 - RNA, 4440 nt, Artificial Sequence
  Synthetic polynucleotide
augcagcgaagcccccuggagaaggccuccgugguguccaaacuguuuuucuccuggaccaggccgauccugaggaagggcuaucgucagcgucuggagcugagcgacaucuaccagaucccgagcgucgacagcgcggacaacuuaagcgagaagcuggagagggagugggaucgggaacuggccagcaaaaagaaccccaagcucaucaacgcccugaggcggugcuucuucuggcgcuucauguucuacgguaucuuccucuaccucggcgaggucaccaaggccgugcagccccugcugcuggguaggaucauagccagcuaugaccccgauaauaaggaggagagauccaucgccaucuaccucggcaucgggcugugccugcuguucaucgugcggacccuccugcugcaucccgccaucuucggccuccaccacaucgguaugcagaugcguauagcgauguucagccugauauacaaaaagacccugaaacugagcuccagggugcuggauaaaaucagcaucggccagcuggugagccugcuguccaacaaucugaacaaauuugacgagggccuggcccuggcccauuucgucuggaucgccccccugcagguggcccuccucaugggccugaucugggagcugcugcaggccagcgcguuuugcgggcugggcuuccugaucgugcuggcccuguuucaagcggggcugggcaggaugaugaugaaguaccgcgaucagagggccgggaagauuagcgagaggcucgugaucacgagcgagaugaucgagaacauccagagcguuaaggccuacugcugggaggaggcgauggaaaagaugaucgagaaccucaggcagaccgagcugaagcucacccggaaggccgcauaugugagguacuucaacagcuccgcauuuuucuucagcggguucuucgugguguuccugagcgugcugcccuacgcccugaucaagggcaucauccucaggaagaucuucaccaccaucagcuucuguaucgugcugcggauggccgugaccaggcaguuccccugggccgugcagaccugguacgacucgcugggcgccaucaacaagauccaggauuuccuccagaaacaggaguacaaaacccuugaguauaaccugaccaccaccgagguggugauggagaaugucacggccuucugggaagagggcuucggcgagcuguucgagaaggccaagcagaacaauaacaaccggaagaccagcaacggagacgacagccuguucuuuagcaacuucagccugcucgggacccccgugcugaaggacaucaacuucaaaaucgagaggggccagcugcuggccgucgccggauccacuggagccggcaagaccucccugcugaugguuaucaugggcgagcuggaaccaagcgaagguaaaaucaagcacuccggccgaaucuccuucuguagccaguucagcuggaucaugcccggcacaaucaaggagaacauuauauucggcguguccuacgacgaguaccgauaccggagcgugauaaaagccugucaacuggaggaggauauaagcaaauucgcggagaaagacaacaucgugcugggcgaaggggguaucacccuguccggcggccaacgugcgaggaucagccuggcccgggccguguacaaagacgccgaccuauaccuccucgacagccccuucggcuaccuggacgugcugacggagaaggagaucuucgagagcugcgucugcaagcugauggccaacaaaacucggauccuggugaccagcaagauggagcaccugaagaaggccgacaaaauucugauccugcacgaaggguccagcuacuucuacgggacguucuccgagcuccagaaccuccagcccgacuucuccagcaagcugaugggcugcgauagcuuugaccaguucagcgccgagaggcgcaacagcauccugaccgagacccugcacagguuuucacuggaaggcgacgcccccgucagcuggacggagacaaagaagcagucauucaagcagaccggcgaguuuggcgagaagaggaagaacucuauccugaaccccauaaacagcauccgaaaguucagcaucgugcagaagaccccccugcagaugaacggcaucgaggaggacuccgacgagccccucgagcggcggcugucgcuggucccggacagcgaacagggcgaggcaauacuccccaggaucuccgugaucagcaccgggcccacccugcaggcccggcgccgacagagcgugcugaaccugaugacccacagcgugaaccagggccagaacauucaccggaagaccacagccuccacccguaaggugagccuggccccgcaggccaaccugaccgagcuggacaucuacagccgaaggcugucgcaggagaccgggcuggaaaucuccgaggagaucaacgaggaggaccucaaggaguguuucuucgacgauauggagagcauccccgccgugaccaccuggaacaccuaccuacgcuauaucacagugcauaagucccugaucuucgugcucaucuggugccucgugauauuucuggccgaggucgccgccagccugguagugcucuggcugcugggcaauacgccccugcaggacaagggcaacagcacccauuccaggaauaacucguacgccgugaucaucaccagcacuuccagcuacuacguguucuauauauacguggggguggcggacacccugcuggccaugggcuucuuucgcggucugccccucgugcacacccucaucaccguguccaaaauccugcaucacaagaugcugcacagcgugcugcaggcccccaugagcacgcucaacacccucaaggccggcgggauccugaauagguucagcaaggacaucgccauccucgacgaccugcugccccucaccaucuucgauuucauccagcuccuccugaucgugaucggcgccaucgccgugguggccguccuccaacccuacaucuuuguggccaccgugcccgugauagucgccuucauaaugcugagggccuauuuucuccagaccagccaacaacugaagcagcuggagucggaggggaggagccccaucuuuacccaccucgugaccagccugaaggggcuguggacgcuccgggccuuuggccggcagcccuacuuugagacgcuguuccacaaggcccugaaccugcauaccgccaacugguucuuguaccucagcacucuccgaugguuccagaugcgcaucgagaugaucuuugucaucuucuucauugccgugaccuuuauaagcauucugacuacgggugagggggaagggcgcguggggaucauccugacccuggccaugaacauuauguccacccugcagugggccgugaacuccuccauugacguggacagccugaugcggagcgugagccgaguguucaaguucauagauaugcccaccgagggcaagcccaccaaguccaccaagcccuauaagaacggccagcugagcaaggugaugaucaucgagaacagccacgugaagaaggacgacauauggccgagcgggggccagaugaccgugaaggaccugaccgccaaguacaccgagggggggaaugccauccuggagaacaucagcuucuccaucucccccggccaaagggugggccuccugggcaggaccggcagcggcaaaagcacucugcucuccgccuuccugcggcugcugaacaccgagggcgagauccagauagacggcgugagcugggacuccaucacccuccaacaguggcgcaaggcguucggcgugaucccccagaaaguguucauuuucagcggcaccuuccgcaaaaaccuagaucccuacgagcaguggagcgaccaggagaucuggaagguggccgacgagguggggcugcguagcgugaucgagcaguuccccggcaaacuggacuucgugcugguggacgggggcugcgugcucagccacggccacaagcagcugaugugccuggcccgguccgugcugagcaaggccaagauccugcugcuggacgagcccagcgcccaccucgaucccgugaccuaccagaucaucaggagaacccugaagcaggccuucgccgacugcaccgugauccugugcgagcacaggaucgaggccaugcuggaaugccaacaguuccuggucaucgaggagaacaaggugcggcaguaugacagcauccagaagcucuugaacgagaggucccucuucaggcaggcaaucagccccagcgacagggucaagcucuucccacaccgaaacuccuccaagugcaaguccaagccccagaucgccgcgcugaaggaagagaccgaggaggagguccaggacacccggcug

SEQ ID NO: 113 - RNA, 4440 nt, Artificial Sequence
  Synthetic polynucleotide
augcagaggagcccgcucgagaaggccagcgugguguccaaacuguucuucuccuggacgaggcccauccugcgcaagggguaccggcagaggcuggagcugagcgacauauaccagauccccucaguggacagcgcggacaaccuguccgagaagcuggagcgcgagugggaccgugagcuggccagcaagaagaaccccaagcugaucaacgcucucaggagauguuucuucuggagguuuauguucuacggcaucuuccuguaccugggggaggucaccaaggccgugcagccccugcuccugggccgcaucaucgccagcuacgacccggauaacaaggaggaaagaagcaucgcgaucuaccugggcaucggccugugccuccuguucaucguucguacccugcugcugcaucccgccaucuucggccuacaccacauaggcaugcagaugaggaucgccauguucucccucaucuacaagaaaacccugaaguugagcagccgggugcuggacaaaaucagcaucggucagcuggugagccugcugagcaacaaccugaacaaguucgacgaaggccuggcccucgcccacuucguguggauagcucccuugcaggucgcccugcugaugggacugaucugggagcugcugcaggccuccgccuucugcggccugggcuuccugaucgugcuggcccuguuccaagccggccugggccgaaugaugaugaaguacagggaccaacgugccgggaagauaagcgagaggcugguuaucaccagcgagaugaucgagaauauucaguccgucaaggccuacuguugggaagaagccauggagaagaugaucgagaaccuuaggcagacggagcucaagcugaccaggaaggcggccuacguacgguauuucaacagcagcgccuucuuuuucagcggcuuuuucguggucuuucugagcgugcugcccuacgcacugaucaaggggaucauccucaggaagaucuuuaccaccauauccuucugcaucgugcugaggauggccgugacccggcaguuccccugggccguccagaccugguacgauagccugggagccaucaacaagauccaggacuuccugcagaagcaggaguacaagacccucgaguacaaccugacuaccacagaaguggugauggaaaacgucaccgccuuuugggaagagggcuuuggcgagcuguuugagaaggccaagcagaauaacaacaaccguaagacaagcaacggcgacgauagccuguucuucagcaauuucucccugcucggcacccccgugcugaaagauaucaacuucaaaaucgagcgcgggcagcugcucgccguggccggguccaccggggccggcaagaccagccugcugauggugaucaugggcgagcuggaacccuccgagggcaagaucaaacauagcggccggaucagcuucugcagccaguucuccuggaucaugcccggcacuaucaaggaaaacaucaucuucggcgugagcuacgacgaguacagguaucguagcgucaucaaggccugccagcucgaggaggauaucuccaaguucgccgagaaggacaauaucguccucggcgagggcggcaucacccugagcggcggccaacgugcgaggauuucacuggcccgggccguguacaaggacgcggaccuguaccuccuggacuccccguucggcuaccuggacgugcucaccgagaaggagaucuucgagagcugcgugugcaagcugauggccaacaagaccaggauccuggugacaagcaagauggagcaccucaagaaagccgauaagauccugauccuacaugagggcagcucguauuucuacgggacuuucagcgagcugcagaaccuccaacccgacuuuaguagcaagcugaugggcugcgacagcuucgaucaguucagcgccgagaggaggaacagcauccucacagagacccugcaccgguuuagccuggagggcgacgcgcccguguccuggaccgagaccaagaagcaaagcuucaagcaaaccggcgaguucggcgagaaaagaaagaacagcauccugaaccccaucaacagcauccgcaaguucuccaucgugcagaagaccccccuccagaugaacgggaucgaggaggacagcgacgagccccuggagcggcggcugagccucgugcccgacagcgagcagggcgaggccauccugcccaggauauccgugaucagcaccgggcccacccugcaggcccggcggagacaguccgugcugaaucugaugacccacuccgugaaccagggccagaauauccacagaaaaaccacugccucaacgaggaaggugagccuggccccccaggcgaaccugaccgagcuggacaucuacagccggaggcugagccaagagaccggccuggagaucuccgaggagaucaacgaggaggaucucaaggagugcuucuucgacgacauggagagcauccccgccgugaccaccuggaacaccuaccugagguacauuaccgugcacaagucccugaucuucgugcugaucuggugccuggucaucuuccuggccgagguggccgccagccucgugguacuguggcugcugggcaacaccccccugcaggacaagggcaacagcacccacagucggaacaacagcuacgccgugaucaucaccuccaccagcucuuacuauguguucuacaucuacgugggaguugccgacacccugcuggccaugggcuucuuccgcggccugccccuggugcacacccugaucaccgugagcaagauccuccaccacaagaugcugcacagcgugcugcaggccccaaugagcacccugaacacccugaaggccgggggcauccucaacagguuuagcaaagacaucgccauccuggacgaccugcugccccugaccaucuucgacuucauccagcuccugcugaucgugaucggggccaucgccgugguggccgugcugcaacccuacaucuucguggcgacggugcccgugaucguggccuucaucaugcugcgcgcauacuuccuccagaccagccagcagcugaagcagcuggagagcgagggcaggucgcccauauucacccaccuggugaccucccucaaagggcuguggacccugagggccuuuggcaggcaacccuacuucgagacgcuguuccacaaggcccugaaccugcacacagccaacugguuccuguaccugagcacgcuccgcugguuccagaugaggaucgagaugauauucgugauuuucuucauagccgugaccuucaucagcaucuugaccacgggcgaaggcgaaggccgagucgguaucauccugacgcuggccaugaacaucaugagcacccugcagugggcggucaauagcagcaucgacguggacucccugaugaggagcgugagccgcguguuuaaguuuaucgauaugccgaccgagggcaagcccaccaaguccaccaagcccuacaaaaacggccagcugaguaagguuaugaucauagagaacagccacgugaagaaggacgacaucuggcccagcggcggccagaugaccgugaaggaccugaccgccaaguauaccgaggguggcaacgccauccuggagaacaucuccuucagcaucucucccggccagcgggugggccugcucggacggaccggaagcggcaagagcacccugcuguccgccuuucugcggcugcucaacaccgagggcgagauccaaaucgacggugugagcugggauagcaucacgcugcagcaguggcggaaggccuucggcgugaucccgcaaaagguguucauuuuuagcggcaccuuuaggaagaaucuggauccguacgagcaguggagcgaccaggagaucuggaagguggccgacgagguaggccugcggagcgucaucgaacaguuccccggcaagcuggacuucguccuggucgacggcggaugcgugcugagccacgggcacaagcagcugaugugccuggccaggagcgugcugagcaaagccaaaauccugcugcuggaugagccguccgcccaccuggaccccgugaccuaucagaucaucaggaggacacugaagcaggccuucgccgacugcaccgugauccucugcgagcaccgcaucgaagccaugcuggagugucagcaguuccuggugaucgaggaaaacaaggugcggcaguacgacagcauccagaagcugcugaacgagaggagccucuuccgccaggccauuagccccagcgacagggugaaacuguuuccccacaggaacucguccaagugcaagagcaagccccagaucgccgcccugaaggaggagaccgaggaggaggugcaggacaccaggcug

SEQ ID NO: 114 - RNA, 4440 nt, Artificial Sequence
  Synthetic polynucleotide
augcagcggucaccccuggaaaaggccuccguggugagcaagcuguucuucuccuggaccaggcccaucuuaagaaagggcuacaggcaacggcucgagcugagcgacaucuaccagaucccguccguggacagcgccgacaaccugagcgagaaguuggaacgcgagugggaucgcgagcucgccuccaagaaaaaucccaaacuuaucaacgcgcugaggagaugcuucuucuggagguucauguucuacggcaucuuccuguaccugggagaggugaccaaggccgugcagccccuccugcucggccgcauaauagccagcuacgaccccgacaauaaggaggagcguagcaucgccaucuaccuggguaucgggcugugccugcuguuuaucgugcgcacccuccugcugcaucccgccaucuucggccugcaccacaucggcaugcagaugcgaaucgccauguuuucgcugaucuacaaaaaaacccugaagcugucaagcagggugcuggauaagaucagcaucggccagcuggugucacugcugagcaacaaucugaacaaguucgacgagggccuggcccuggcccauuucguguggaucgccccccuccagguggcgcugcugaugggccucaucugggagcugcugcaggcguccgccuucugcggucugggcuuccugaucgugcuggcccucuuucaggccgggcucgguaggaugaugaugaaauacagggaccagagagccggcaagauuucagaaaggcuggugaucaccagcgaaaugaucgagaacauccaauccgugaaggccuauugcugggaggaagccauggagaagaugaucgagaaccugcgacagaccgaacucaagcucacccggaaggccgccuacgugagguacuucaacuccuccgccuucuucuuuagcggcuucuucguggucuuucugagcgugcugcccuacgcccucaucaagggcaucauccugaggaagaucuuuaccaccaucuccuucuguaucguccuccgaauggccgugacgcgucaguuccccugggcuguccagacuugguaugacagccuaggggccaucaacaagauccaggauuuccugcaaaaacaggaguacaagacccuagaguacaaucucaccaccacggaggucgugauggagaacgugacggccuucugggaggagggcuucggggagcucuuugaaaaggccaagcagaauaacaacaauaggaagacgagcaauggcgacgacagccucuucuucagcaacuucagccugcuggggacgcccgugcucaaagacaucaacuucaagaucgagcgggggcagcugcuggccguggccggaagcacgggagccggcaagaccagccugcugauggugaucaugggggagcucgaacccuccgaaggcaagaucaagcauagcgggaggaucagcuucugcagccaguucuccuggauaaugccagggaccaucaaggagaacaucaucuuuggcgugagcuacgacgaguacagguaucggucugucaucaaagccugccagcuggaagaggauaucagcaaguuugcagagaaggacaacaucgugcugggggaaggcggcaucacccugagcggcgggcagcgcgccaggaucucccuggcccgugcgguguacaaggacgccgaccuguacuuacuggacagccccuucggcuaucuggacgugcuaaccgagaaggaaaucuucgaguccugcguguguaagcugauggccaacaagacccgcauccuggugaccuccaagauggagcaccucaagaaggccgauaagauccugauccugcacgagggcuccagcuacuucuacggcaccuucagcgagcugcaaaaccuccaacccgacuucucuagcaagcucauggggugcgacucguucgaccaguucagcgccgaaaggcggaacagcauccugacugagacccugcacagguucagccuggagggggaugcccccgugagcuggacugaaaccaagaagcaguccuucaagcagaccggcgaguuuggcgagaagaggaagaacagcauccugaaccccaucaacucgauccgcaaguucagcauagugcagaaaaccccccugcaaaugaacggcaucgaggaggacuccgacgaaccccucgagaggaggcugagccucgugccggacagcgagcagggggaggcgauucucccccgcaucuccgucaucagcacgggucccacccugcaagccaggcgucggcaauccgugcugaacuugaugacccacuccgugaaccagggccagaacauccauaggaaaaccaccgccagcacccggaaggugucacuggccccccaggcgaaccuuacggagcuggacaucuacagccgacggcuuagccaagagaccggccuggagaucagcgaagagaucaacgaggaggaucugaaagagugcuucuuugaugacauggaaagcauccccgccgugacuaccuggaauaccuaucugcguuauaucaccguccacaaaucccugaucuucgugcugaucuggugccuggugaucuuucuggcugaaguggccgccucccugguggugcuguggcuccugggcaacaccccccugcaggacaaaggcaacagcacgcacagccggaacaacuccuacgccgugaucaucaccuccaccagcuccuacuacgucuucuacaucuacgugggggucgccgacacccugcuggccaugggcuuuuucaggggccugccacugguccacacccugaucaccgugagcaaaauccugcaucacaagaugcuccacuccgugcugcaggcccccaugagcacccugaauacccugaaggccggcggcauccugaaccgcuuuagcaaggacaucgccauccuggacgaccugcugccccugaccauuuuugacuuuauccagcugcugcugaucgugauaggcgccaucgccgugguggccguccugcagcccuauaucuucguggcaacggucccggugaucgucgccuucaucaugcuuagagccuauuuccugcagacgucccagcaacugaagcagcuggagagcgagggcaggagcccgaucuuuacccaccucgugaccagucugaagggccuguggacccugcgggccuucggacggcaacccuacuucgagacccuguuccacaaggcccugaaccugcacacagccaacugguuccuguaccugagcacccugaggugguuccagaugaggaucgagaugaucuuugugaucuucuucaucgccgugaccuucauuagcauccugacgaccggagagggcgagggccgcgucggcaucauccugacccuggccaugaauaucaugagcacccugcagugggccgugaauagcuccaucgacguggacagccucaugcgaagcgugagcaggguguucaaguuuauagacaugcccaccgagggcaagcccaccaagagcaccaaacccuacaagaacgggcagcucuccaagguuaugaucaucgagaauagccaugugaagaaggacgauaucuggccguccggcggccagaugaccgugaaggaccucaccgcaaaguacaccgagggcgggaacgcaauccucgagaacaucagcuucagcaucucccccgggcagcgggugggcuugcuugggcgcacaggcagcggaaagagcacccugcugagcgccuucuugcgacugcucaacaccgagggggagauccagaucgacggcgucucaugggacuccaucacgcugcagcaguggcggaaggccuucggggugaucccccagaaggucuucaucuuuuccggcaccuuccggaagaaccuggaccccuacgagcagugguccgaccaagagauuuggaagguugccgacgaggugggccugaggagcgugaucgagcaguuccccggcaagcucgacuucguccugguggacgggggcugcgugcugagccacgggcacaagcagcugaugugccuggccaggagcguccugagcaaagccaagauccuccugcuugacgagcccagcgcccaccuggacccggugacguaccagaucauccgcaggacgcugaaacaggcauucgccgacugcaccgugauccucugcgagcauaggaucgaggccaugcuggagugccagcaguuccucgucaucgaggagaauaaggugcggcaguacgauuccauccagaagcugcugaacgagaggagccuguuccggcaagccaucucgcccagcgaccgggugaagcuguucccccaucguaacagcagcaaaugcaagagcaagccccagauugccgcccugaaggaagagaccgaggaggaggugcaagacacgcgccug

SEQ ID NO: 115 - RNA, 4440 nt, Artificial Sequence
  Synthetic polynucleotide
augcagcgcagccccuuagaaaaggccagcguuguguccaagcuguucuucuccuggacccggcccauccugcgcaagggcuauaggcagaggcuggagcugagcgauaucuaccagauacccuccguggacagcgccgacaaccugucggagaaacucgagcgggagugggacagggaacuggccagcaagaagaacccgaagcugaucaacgcccuccgacgguguuucuucuggagguucauguucuacggcaucuuccuguaucugggggaagugaccaaggccgugcagccccugcuccugggccggauuaucgccagcuaugaccccgacaacaaggaggagcgaucgauugccaucuaccucggcaucggccugugccugcuguucaucguaaggacccuccugcuacacccggccaucuucggccugcaccacaucggcaugcagaugcggauagccauguucucccugaucuacaagaagacgcugaagcuuagcagccgggugcuggacaagaucagcauaggccagcuggugagccugcugagcaacaaucugaauaaguucgacgagggacuggcccucgcgcauuucguguggaucgccccccugcagguggcucugcugaugggccugaucugggagcugcuccaggccagcgccuucugcggccucggcuuccucaucgugcuggcccuguuucaagccggccucggccggaugaugaugaaguacagggaucagcgggccggaaagaucuccgagaggcuggugauuaccuccgagaugaucgagaacauccaguccgugaaagccuacugcugggaagaggcaauggagaagaugaucgagaaucuccgccagaccgagcugaagcugacacguaaggccgccuaugucagguacuucaacagcagcgccuucuucuucuccggcuuuuucgugguguuccugagcgugcugccguaugcccugaucaagggcaucauccugaggaaaaucuucacgacgaucagcuuuugcauugugcugcggauggccgucaccaggcaguuccccugggccgugcagaccugguacgacucccugggggccaucaacaagauccaagauuuccuccagaagcaggaguacaagacgcuggaguauaaucugaccaccaccgaaguggugauggagaacgugacagccuucugggaggagggcuuuggagagcucuuugagaaggccaagcagaacaacaacaaccggaagaccagcaacggcgacgacucucuguuuuuuagcaacuuuagccugcuggggacccccgugcugaaggacaucaacuucaagaucgagaggggccagcuccuggcgguggccggcagcaccggagccggcaaaaccucccuccugauggucaucaugggcgaacuggaacccagcgagggcaaaaucaagcacuccggccgaaucuccuucugcucccaguucuccuggauaaugcccgguacaauaaaggagaacaucaucuuuggggugagcuacgacgaguaccgcuacaggucggugauaaaggccugccagcuggaggaggacaucagcaaguucgccgaaaaggacaacaucgugcugggggaggguggcauaacccucagcggcgggcagagggcgaggaucagccuggccagggccguguacaaggacgccgaccuguaccugcuggacucccccuucggcuaccuagauguguuaacggagaaggagaucuucgaguccugugugugcaagcugauggccaacaagacccgcauccucgugaccagcaaaauggaacaccucaagaaggcagacaagauccugauccugcacgaggguuccagcuacuucuacggcacguucagcgagcugcagaaucugcagcccgacuucucgucgaagcucauggguugugauagcuucgaucaguucagcgcggagcgaaggaacuccauccugaccgagacccugcacagguucucccuggaaggggacgcccccgugagcuggaccgagaccaagaagcaaagcuucaagcagaccggagaguuuggggagaagcgcaagaauagcauccugaaucccaucaacagcauccggaaguucuccaucgugcagaaaaccccccugcagaugaacggcaucgaggaggauagcgacgagccccuugagaggcggcugagccuggugcccgacagcgagcagggggaggccauccugccccggaucuccguuaucuccaccggcccgacccugcaggccaggaggcgccaaagcgugcugaaucugaugacucacuccguaaaccagggccagaacauucacaggaagaccaccgccagcacccgaaaggugagccuggccccccaggccaaccugaccgagcuggacaucuacagccggcgccugagccaggagacaggacuggagaucagcgaagagaucaacgaagaggaccucaaggagugcuucuucgacgacauggagagcauccccgccguaaccaccuggaacaccuaucugagguacaucacggugcacaagagccucaucuucgugcucaucuggugucuggucaucuuccuggcagaggucgccgcgagccuggugguccuguggcugcugggcaacaccccccugcaggacaagggaaacagcacccauucccggaacaauagcuacgccgucaucaucaccagcaccuccagcuauuacguguucuauaucuacgucgggguggcggacacccuccuggcgaugggcuucuucaggggccugccccuggugcacacccugaucaccgugagcaagauccugcaccacaagaugcugcacuccgugcugcaggcccccaugagcacccucaauacguugaaagcgggcggaauccugaacagguucuccaaagacaucgccauccuggacgaccugcugccgcugaccaucuucgauuucauccagcugcugcugaucgugauaggagccaucgccgucguagccguccugcagcccuacaucuucguggcgaccgucccggugaucguggcguucaucaugcugcgggccuacuuccugcagaccagccagcagcugaagcagcuggaaagcgagggccgaucccccaucuucacgcaccuggucaccucccugaagggccuguggacccugcgggcauucggcaggcagccguacuucgagacccucuuccacaaagcccugaaccugcacacagccaacugguuccucuaccucagcacccuccggugguuucaaaugagaaucgagaugaucuuugugauauucuucaucgccgugacguucaucagcauccugacaaccggcgagggagaggguagggugggcaucauccugacccucgccaugaacaucaugagcacacugcaaugggcggugaacagcagcaucgacguggacucccugaugcgguccgucagcaggguguucaaauucaucgacaugccaaccgagggcaagccaaccaagagcaccaagccguacaagaauggccaacucagcaaggugaugaucaucgaaaacagccacgugaaaaaggacgacaucuggcccuccggcgggcagaugaccgugaaggaccugaccgcgaaguacaccgaggggggaaacgccauccuggagaauaucuccuucaguaucagcccgggccagagggucggacuccugggcaggaccggcagcggcaaguccacccugcugucagccuuccugcgccugcugaacacggagggcgagauccagauagacggggugucaugggauagcaucacccugcagcaguggaggaaggccuucggggucaucccccagaagguguucaucuucuccgguaccuucaggaagaaccuggacccguacgagcaaugguccgaccaggagaucuggaagguugccgacgaggucggccugagguccgugaucgagcaguuccccggcaagcucgacuuugugcugguggaugggggcugcgugcucagccacggccacaagcagcugaugugccucgccaggagcgugcuguccaaagccaagauccugcugcuggacgagcccagcgcccaucuggaucccguuaccuaucagaucauccggcggacgcugaagcaggccuucgccgacuguacagugauccugugcgagcacagaaucgaggccaugcuggagugccagcaguuccuggugauugaagagaacaaggugcggcaguacgacagcauacagaagcugcugaacgaaaggucccuguuuaggcaagccaucagccccagcgacagggugaagcuguuuccccaccgaaacagcagcaaaugcaaguccaagccccagaucgccgcgcugaaagaggaaacagaggaggagguacaggacacacggcua

SEQ ID NO: 116 - RNA, 4440 nt, Artificial Sequence
  Synthetic polynucleotide
augcagcgcagcccgcucgaaaaggccagcgucgugucgaagcuguucuuuagcuggacccgacccauccugagaaagggcuaucgucagaggcuggagcugucggacaucuaccagauccccuccguggacagcgccgacaaucucuccgaaaaacuggagcgugagugggaucgcgagcuggccuccaagaagaaccccaagcugaucaacgcccugaggagguguuucuucuggagguucauguucuauggcauauuccuguaccugggcgaggugaccaaggccguccagccccugcuccucggcaggaucaucgcaagcuacgauccugacaacaaggaggaaaggagcaucgccaucuaccugggcauaggccugugccugcuguucaucgugcgcacccugcugcugcaccccgccauauucgggcugcaccacaucgggaugcagaugcgcaucgccauguucagccugaucuacaagaagacucugaagcuguccagucgggugcuggacaaaaucuccauaggacagcuggugucgcugcugagcaacaaccugaauaaguuugacgaggggcuggcccuggcccauuucguguggaucgccccccugcaagucgcccugcugaugggccugaucugggagcuccugcaggccagcgccuuuugcggccugggguuccucaucguccuggcccuguuccaggcaggccugggccggaugaugaugaaauacagggaccagagggcgggcaagaucagcgagaggcuggugaucaccuccgagaugaucgagaacauccagucggugaaggcuuacugcugggaggaggccauggagaagaugaucgaaaaccucaggcagacggagcugaagcugaccaggaaggccgccuacgugagguacuucaacucauccgccuucuuuuucuccggauucuucgugguguuccuguccgugcugcccuaugcccugaucaagggcaucauccuccggaagaucuucacaaccaucuccuucugcauuguacugaggauggccgugacuaggcaguuccccugggccguccagaccugguacgacagccugggcgcaaucaacaagauccaggacuuucugcagaagcaagaguauaagacccuggaguacaaccugacgacuacggagguggucauggaaaacgugaccgcauucugggaggaggguuucggggaacuguucgagaaggccaagcagaacaauaacaacaggaagacgagcaauggcgaugauagccuguucuucagcaacuucagccuccuggggacccccgugcugaaggacaucaacuuuaagaucgagcgaggccagcugcuggccguggccggcuccaccggagccggcaagacaucauugcugauggugaucaugggcgaacucgaacccagcgaggggaagaucaagcacuccgggaggaucuccuucugcagccaauucagcuggaucaugccgggcaccaucaaagagaacaucaucuuuggcguguccuacgacgaguaccgguaucguagcgucaucaaggccugucagcuggaggaggacaucuccaaguucgccgagaaggacaauauagugcugggcgagggcgguaucacccugagcgggggccagagggccaggaucucccuggcccgggccguguacaaagacgccgaucuguaccugcuggacagccccuucggcuaccuggacgugcugaccgagaaggagaucuuugaaagcugcguaugcaaacugauggccaacaaaacccguauccuggugaccagcaagauggagcaccucaagaaggccgauaagauccugauccugcaugagggcagcuccuauuucuacggcaccuuuagcgagcugcagaaccugcagcccgauuucagcagcaagcugaugggcugcgacagcuucgaccaguucagcgccgaaaggaggaacuccauccucacggagacccugcacagguucagccuggagggcgaugcgccggucuccuggaccgaaacgaaaaagcaguccuucaagcagaccggcgaguucggagaaaaacgaaagaauuccauccugaaccccauaaacuccauccggaaauucuccaucgugcagaagaccccgcugcagaugaacgggaucgaggaggacagcgacgagccccuggagcgaaggcugucccuggugcccgauagcgaacagggcgaagccauccugcccaggaucagcgugaucagcaccggccccacgcugcaagcgcgcaggcgucaaagcguccugaaccugaugacccacagcgugaaccagggccaaaacauccaccgcaaaaccacugccagcacccggaaggugagccuggccccgcaggcaaaucugaccgaacuggacaucuacagccgcaggcugagccaggaaacgggucucgagaucagcgaggagaucaacgaggaggaccugaaagaaugcuuuuucgacgacauggaguccauucccgccgugaccaccuggaacaccuaccugagguauaucaccgugcacaagagccugaucuucgugcugaucuggugccuggugaucuuucuggccgaaguggcugccagccugguggugcuguggcuccugggcaauaccccccugcaagacaagggcaacuccacccacucccggaacaacagcuacgccgugaucaucaccagcaccagcaguuacuauguguucuacaucuacgucgggguggcggacacacugcucgcaaugggauucuuccgcgggcugccgcuggugcacacccugaucaccgucagcaagauccugcaucacaagaugcugcacagcguccugcaggcccccauguccacccucaacacccugaaggccggggggauccugaaccgguucuccaaggacaucgccauccuggacgaccugcugccccugaccaucuucgauuucauccagcugcugcugaucgugaucggggccaucgccgugguggcggugcugcagcccuacaucuuuguugccaccgugccggucauuguggccuuuaucaugcuccgggccuacuuccugcaaaccagccagcagcugaagcaacuagaauccgaagggaggagccccaucuucacccaucuggugaccucccucaaggggcuguggacccugagggccuucggcagacagcccuacuucgagacccuguuccacaaagcccugaaucugcacaccgccaacugguuccucuaccugucaacccugaggugguuccagaugcgcauagaaaugauauuugugauauucuucaucgccgugacguucaucagcauacugaccaccggggagggagaggggcgugugggcaucauccugacccucgcgaugaacauuaugagcacccugcagugggccgugaacagcuccaucgacguggacagccugaugcgcuccgugagcaggguguuuaaguucaucgacaugcccaccgagggcaagcccaccaagagcaccaagcccuauaagaacggccagcucuccaaggugaugaucaucgagaacucccacgugaagaaagacgauaucuggcccagcggcggccagaugaccgugaaggaucugaccgccaaguacaccgagggagggaacgccauccucgagaacaucuccuucagcaucagccccggccagagggugggccugcugggccggaccggguccggcaagucaacgcugcugagcgccuuccugagacuccucaacaccgagggcgagauacagaucgacggggugagcugggacuccaucacccugcaacaguggcguaaagcuuucggggucaucccccagaagguguucaucuucagcggcacauuccggaagaaccuggaccccuaugagcagugguccgaccaggagaucuggaagguggccgaugagguuggccugagguccgugaucgagcaauuccccggcaaguuagacuuugugcugguggacgggggcugcgugcucagccacgggcacaagcagcugaugugccuggccaggagcguguugagcaaggccaagauccuccuucuggacgagcccuccgcccaccuggacccagucaccuaccagaucaucaggcgaacccugaagcaggccuucgccgacugcaccgugauccugugugagcaccggaucgaggccaugcuggagugccagcaguuccuggugaucgaggagaacaaggugcggcaguacgacagcauccagaagcuccugaacgagaggagccuguuccgccaggccaucagccccagcgaccgggucaagcuguucccccaccgcaacuccagcaagugcaagagcaaaccccagaucgccgcacugaaggaggagacggaggaggaggugcaagacacccgccug

SEQ ID NO: 117 - RNA, 4440 nt, Artificial Sequence
  Synthetic polynucleotide
augcagcggagcccccuggagaaggcuagcgucguguccaagcuguucuuuagcuggacccgacccauccuccgcaaaggguauaggcagaggcucgagcuguccgauaucuaccagauccccuccguggacagcgccgauaaccucucugagaagcuggagcgggagugggaccgcgagcuggccagcaagaagaaucccaagcucaucaacgcacugaggcggugcuucuuuuggcgguucauguucuauggcaucuuucuguaccugggggaggucaccaaggccgugcaaccccuccuccucggcaggaucaucgccuccuaugaccccgacaacaaagaggagagguccauagccaucuaccuggguaucggccugugccugcuguucaucgugcguacccugcugcugcacccugcgauauucgggcugcaccacaucggaaugcagaugaggaucgcgauguucucccucaucuauaagaagacccugaagcugagcagcagggugcucgacaagaucagcaucggacagcuggugucgcugcuguccaacaaccuaaacaaguucgaugaggggcuggcccucgcccauuucguguggaucgccccccugcaaguggccuugcuaaugggccucaucugggagcugcugcaggccuccgccuucugcggccugggauuccugaucguccuggcccuguuccaggccgggcugggccgcaugaugaugaaguacagggaucagcgggccggaaagaucagcgagcgccucgugaucaccuccgagaugaucgagaacauccaguccgugaaggccuacugcugggaggaggccauggagaagaugauagaaaaucucaggcagaccgagcugaagcugacuaggaaggcggccuacgugagguacuuuaacagcuccgccuucuucuucagcggcuuuuuugugguguuccucucggugcugcccuacgcccugaucaagggcaucauucugcgcaagaucuucaccaccaucucauucugcauagugcugaggauggccgugacccgacaguucccuugggcugugcagaccugguaugacagccucggggccaucaacaagauccaggacuuucugcagaagcaggaguauaagacccucgaguacaaccugaccaccaccgagguggucauggagaacgucaccgccuucugggaggaaggcuucggagagcuguucgagaaagccaaacagaacaacaacaacaggaagaccuccaacggcgaugauucgcuguucuucagcaauuucagccuccugggcacccccgugcucaaggacaucaacuucaaaaucgagagggggcagcugcuggccguggcggguagcaccggcgccggcaagacaagccugcucauggucaucaugggcgagcuggagcccagcgaggggaaaaucaagcacagcgggcggaucagcuucugcucacaguucaguuggaucaugcccgggaccaucaaggagaacaucauauuuggggugagcuacgacgaguaccgguacagguccgugaucaaggcgugccaacuggaagaggacaucagcaaguucgccgagaaggacaacaucgugcugggagaggguggaaucacccugagcggugggcagcgggccaggauaagccucgccagggccguguacaaagaugccgaccuguaccugcuggacuccccguucggcuaucuggacgugcugaccgaaaaggagaucuucgaguccugcguguguaagcucauggcgaacaagacccggauccuggucaccuccaagauggagcaccugaagaaggcggacaagauacucauacugcacgaggggagcucauacuucuacggaaccuuuagcgagcugcagaaccuccagcccgacuucagcuccaagcugauggguugcgacagcuucgaccaguucagcgccgagaggcggaacagcauacugaccgagacccugcauagguucucccucgagggggacgccccgguguccuggacggagaccaaaaaacagagcuucaagcagacgggggaauucggcgagaagcggaaaaacagcauccucaaccccaucaacagcauccggaaguuuagcaucguccagaagacgccccugcagaugaacggcaucgaggaggacagcgaugagccccucgagaggaggcugagccuggugcccgacagcgagcagggcgaggccauccugccacggaucagcgugaucagcaccgggcccacgcugcaggcccggaggcggcaguccgugcugaaccucaugacucacagcgugaaccagggacagaacauccacaggaaaacaacggccuccacccgcaaggucucccuggccccccaagccaaccugaccgagcuggacaucuacucgaggaggcugagccaggagaccggccuggagaucagcgaggagaucaacgaagaggaccugaaggagugcuucuuugacgauauggaguccauccccgcggugacgacguggaauaccuaccuuagguacaucaccgugcauaagagccugaucuucgugcugaucuggugccuggugaucuuccuggccgagguggccgcaucccugguggugcuguggcuccugggcaauaccccccugcaggacaaaggcaacagcacucauagcaggaauaacuccuacgccgugauaaucacaagcaccagcagcuacuacguguucuacauauaugugggcguggccgauacccugcuggccaugggcuucuucagggggcugccccuggugcacacccugaucacggugagcaagauccugcaccacaagaugcuccacagcguacugcaggcccccaugucgacucugaacacccugaaggccggcgggauacugaacagguucagcaaggacaucgccauccuggacgaccugcugccccucacgaucuucgacuucauccagcugcugcugaucgugaucggggccaucgccgugguggccgugcugcagcccuacaucuucgucgccaccgugcccgugaucguggccuucaucaugcugagggccuacuuccuccagaccagccagcagcugaagcagcuggagagcgaggggaggagccccaucuucacccaucuggugaccucccugaaggggcuguggacucuccgcgccuucggcaggcagccguacuucgagacgcuguuccacaaggcccugaaccuccacaccgccaacugguuccuuuaucugagcacccuucggugguuccagaugcguaucgagaugaucuucgugaucuucuuuaucgccgugaccuuuaucagcauucugaccaccggagagggggaggggcggguggggaucauccugacgcuggccaugaauaucauguccacccugcaaugggccgugaacuccuccaucgacguggauagccugaugcgauccgucagcaggguguuuaaguucaucgacaugcccaccgagggcaagccgaccaagucgaccaagccguacaagaacggucagcuguccaaggucaugaucauagaaaacucccacgugaagaaggaugacaucuggcccuccggcggccagaugaccgugaaggaccugaccgccaaguacaccgagggcgggaacgcuauccuggagaacaucuccuucagcaucucccccggccagagggugggcuugcucgggaggaccggcagcgguaagagcacccugcuguccgccuuccugaggcugcugaacaccgagggcgaaauccagauagauggcgugagcugggacuccaucacccuccagcaguggaggaaggccuucggcgugaucccccagaaggucuuuauuuucagcggcaccuuuaggaaaaaucucgacccguaugaacaguggagcgaccaagaaaucuggaagguggcagacgaggugggccugagauccgugaucgagcaauuccccggcaagcuggauuucgugcuggucgacggcggcugcgugcucagccacgggcacaagcagcugaugugccuggccagguccguccucagcaaggccaagauccugcugcuggacgagcccuccgcccaucuggaccccgugaccuaccagaucaucaggcggacccucaagcaagccuucgccgacugcaccguuauacugugcgagcacaggaucgaggccaugcuggagugccaacaguuccuggucaucgaagagaauaaggugaggcaguacgauagcauccagaagcugcugaacgagcggagccuguuucgucaagccaucagccccagcgacagggugaagcuguucccccaccgcaacuccucaaaaugcaagagcaagccccagaucgccgcccucaaggaggaaaccgaggaggagguccaggacacccggcug

SEQ ID NO: 118 - RNA, 4440 nt, Artificial Sequence
  Synthetic polynucleotide
augcaacggucgccccuggagaaggccucgguggugagcaaacuguucuucagcuggaccaggcccauccugcggaagggcuauaggcagcggcucgagcucagcgacaucuaucagauccccucggucgacuccgccgacaaccuguccgagaaacuggagcgcgagugggacagggaacuggccagcaagaagaauccgaaacugaucaacgcccucaggcgcugcuucuuuuggagguucauguucuacggcauauuccuguaccugggcgaggugaccaaggccgugcagccccuccugcugggacgaaucaucgccuccuacgaccccgauaacaaggaggagcgcagcaucgccaucuaccugggcaucggccugugccugcuguucaucgugcggaccuuacugcugcacccggccaucuucgggcugcaccacaucggcaugcagaugaggaucgcaauguucagccugaucuacaagaagacccugaagcucucuagccgcgugcucgacaagaucagcauaggccaacuggugagccugcugagcaacaacuugaacaaguucgaugagggccuggcccuggcccacuucguuuggaucgccccccuucaaguggcgcugcuuaugggccugaucugggagcugcugcaggccagcgccuucugcggccucggguuccugauagugcuggcccuguuccaggcggggcucggcaggaugaugaugaaguacagggaccagcgcgccgggaagaucagcgagcggcuggugaucaccuccgaaaugaucgagaacauccagagcgugaaggccuacugcugggaggaggccauggagaagaugauagaaaaccugaggcagaccgagcucaagcugaccaggaaggccgccuacgugcgguacuuuaacagcagcgccuucuucuuuagcggcuuuuucgugguguuccugagcgugcugcccuacgcccugaucaagggcaucauccucaggaaaaucuucaccaccaucagcuuuugcaucgugcuccgaauggccgugacccggcaguuccccugggccguccaaaccugguacgacagccugggcgccauaaauaagauacaggacuuccugcagaagcaggaguacaagacccuggaguacaaccugaccaccaccgagguggugauggagaacgugaccgccuucugggaggaaggguucggcgagcuguucgagaaagccaaacaaaauaacaacaaucgaaagaccuccaacggcgacgacagccuguucuucagcaauuuuagccugcugggcacccccgugcugaaggacaucaauuucaagaucgaaaggggccaacugcuggccguggccgggagcaccggggcgggaaagaccucccuucugauggugaucaugggcgagcucgagcccagcgaggggaagaucaagcacaguggaaggauaagcuucugcagccaauucagcuggaucaugccggggaccaucaaggagaacaucaucuucggcguaagcuacgaugaguaccguuaccggagcgugaucaaggccugccagcuggaggaggacaucagcaaguuugccgagaaggauaacaucgugcugggcgagggcggcaucacccugaguggcggccagagggccaggaucagccuggccagggccguguauaaggaugccgaccucuaccugcuggacucccccuucggauaccuggacgugcugaccgaaaaagagaucuucgagagcugcgugugcaagcucauggccaacaagaccaggauccucgucaccagcaaaauggagcaccugaagaaggccgauaagauacugauccugcacgaggggagcuccuacuucuacggcaccuucagcgaacugcagaaccugcagcccgacuucuccagcaagcucauggggugcgacagcuuugaccaguucagcgcggaacgucggaacuccauccugaccgagacccugcauagguucagccuggagggggacgccccggucagcuggaccgagacaaagaagcaguccuuuaagcagaccggcgaguucggagagaaacgcaaaaacagcauccugaaccccaucaauagcaucaggaaguuuagcaucgugcagaagaccccccugcagaugaacggcauugaggaggacagcgacgaaccccuggagcgcaggcugagccuggugcccgacagcgaacagggcgaggccauccugccccggaucagcgucaucagcaccggcccuacccugcaggccaggcguaggcagagcgugcugaaccucaugacccauuccgugaaucaaggucagaacauccaccgcaagaccaccgccagcaccaggaaggucucccuggccccccaggccaaucucaccgagcuggauaucuacagcaggcgccugagccaggagaccggccuggagaucagcgaggagaucaacgaggaggaccugaaggagugcuucuucgacgacauggagagcauacccgccgugaccaccuggaacacguaccuccgguauaucaccguccacaaaucccugaucuucgugcugaucuggugccuggugaucuuccuggccgagguggccgccagccugguggugcucuggcuguugggcaacacaccccugcaggacaagggcaacagcacgcauucccggaacaauagcuacgccgugaucaucacgucgaccagcucguacuacguguucuacaucuacgugggcguggcggacacgcugcuggccaugggcuucuuucgcgggcugccccuggugcacacccugauaaccgugagcaagauccugcaccauaagaugcuccacagcguccuccaggcccccaugagcacccugaacacgcugaaggccggcgggauccugaacagguucucuaaggacaucgccauccucgacgaccugcugccccugacuaucuucgacuucauccagcugcugcucaucgugaucggcgccaucgccgugguggccgugcugcagcccuacaucuucgucgcaaccgugccagugaucguggccuucaucauguugagggccuacuuccugcagaccagccagcagcugaagcaacuggagucggagggaaggagccccaucuucacccaucuggucaccagccugaaaggccuguggacccugagggccuuuggccggcagcccuacuucgagacccuguuccacaaggcccugaaccugcauaccgccaacugguuccuguaccuguccacccugcggugguuccaaaugaggaucgagaugaucuucgugaucuucuucaucgccgugaccuucaucuccauccuuaccacaggcgagggcgagggcaggguaggcauaauccugacccuggccaugaacaucauguccacgcugcagugggccgucaacagcagcaucgacguggacagccucaugagguccguguccagggucuucaaauucaucgacaugcccaccgaggggaagcccaccaaaagcaccaagcccuacaagaauggacagcugagcaaggugaugaucaucgagaacagccaugugaagaaagacgauaucuggccgagugggggccagaugacggugaaggaccugaccgccaaguacaccgagggcggcaacgcgauccuggagaacauuagcuucagcaucucucccggacagcgggucgggcugcucggccgaaccggaagcgggaaguccacacugcuguccgcguuccugcgucugcugaauaccgagggggagauccaaaucgacggcgugagcugggacagcaucacccugcagcaguggcggaaggccuucggcgucaucccccagaagguguucaucuuuagcgggaccuuuaggaagaaccuggaucccuaugagcaguggagcgaccaagagaucuggaagguggccgaugagguaggccugagaagcguuaucgagcaguuccccggcaagcuggacuucguccuggucgacggcggcugugugcucagccacggccauaaacagcugaugugccuggcccgaagcgugcugagcaaggcgaaaauccuccugcuggacgagcccucggcccaccuggaccccgugacuuaccagaucauucgacguacccugaagcaggccuuugccgauuguaccgucauacugugcgagcacaggaucgaggccaugcuggagugccaacaguuccuggugaucgaggaaaacaagguacgccaguacgacagcauccagaagcuccugaacgagcggucccucuuuaggcaggccaucagccccuccgaccgugugaagcuguucccccacaggaacagcagcaaguguaagagcaagccccagauagccgcccugaaggaggagaccgaggaggaagugcaggacacccggcug

SEQ ID NO: 119 - RNA, 4440 nt, Artificial Sequence
  Synthetic polynucleotide
augcagaggagcccccuggagaaggccagcgugguguccaagcuuuucuuuuccuggacccgcccgauccugcgaaagggguauaggcagcgccuggaacuguccgacaucuaucagaucccgagcguggacagcgccgacaaccugagcgagaagcuggagagggagugggauagagagcuggccuccaaaaagaaucccaagcucaucaacgccuugcggcgaugcuucuuuuggagguuuauguucuacggcaucuuccucuaccugggagaggugacgaaggccgugcagccccuccugcugggcagaaucaucgcaucuuacgaccccgacaauaaggaggaaagguccaucgcgaucuaccugggcauugggcugugccuccuguuuaucgugcggacccugcugcugcaucccgccaucuucggacuccaccauaucgggaugcagaugcggaucgcaauguucucacugaucuacaagaagacccugaagcucuccagccgggugcuggacaagauaagcaucggccagcuggugucccugcugagcaacaaccugaauaaguucgacgaggggcuggcccuggcccauuucguguggaucgccccccugcaaguggcacugcugaugggccugaucugggagcugcugcaggcuagcgcuuucugcggccucggcuuccugauuguccucgcccuguuccaggccgggcugggcaggaugaugaugaaguaccgggaccagagggcaggcaagauaagcgagcggcuggugaucaccuccgagaugaucgagaacauucagagcgugaaggccuacugcugggaggaggcaauggagaagaugaucgaaaaccugcggcagaccgagcugaaacucaccaggaaagccgcguacgugagguacuuuaacuccuccgccuuuuuuuucagcggcuuuuuugugguguuucugagcguacugcccuaugcccucaucaaaggcauuauccugcgcaagaucuuuacaaccaucucguucugcaucgugcugcgaauggccgugacccgccaguucccgugggccguccagaccugguacgacucccucggcgcgaucaacaaaauacaggacuuccugcagaaacaggaguacaaaacccuggaguacaaccucaccaccacggagguggugauggaaaacgugaccgccuucugggaggaaggcuuuggcgaacuguucgagaaggccaagcagaacaacaacaaccgcaaaaccagcaacggggaugacagccuguucuucagcaacuucucccugcucggaacucccgugcugaaggacaucaacuucaagauagagcgcggccagcuccuggccguggccggcuccaccggcgccggcaagaccagccugcucauggugauaaugggggaacuggagcccucggaggggaagaucaaacacuccggccgaauaagcuucuguagccaguucuccuggaucaugcccggcacgaucaaggaaaacaucaucuucggcgucuccuacgacgaguaccgguaccgaagcgugauuaaggccugccagcuggaagaggacaucagcaaguucgccgagaaggacaacaucgugcugggcgagggcggcaucacacugagcggcggccagagggcaaggaucagccuggcucgggcgguguauaaggacgccgaccuguaccuucuggacagccccuuuggauaccuggaugugcugaccgagaaggagaucuucgagagcugugugugcaaacugauggccaauaagacccguauccuggugaccagcaagauggagcaucucaagaaagccgauaagauccugauccugcacgaaggcuccagcuacuucuacggcaccuuuuccgagcugcagaaccugcagcccgauuucuccagcaagcugauggggugcgacuccuuugaccaguucagcgccgagagacgcaacuccauacugaccgaaacccugcaccgauuuucccucgagggcgaugcgccgguguccuggaccgagaccaagaagcagagcuucaagcagaccggcgaguuuggggaaaagaggaagaacucgauacugaaccccaucaacuccaucaggaaauucagcauugugcagaagaccccccugcagaugaacggcaucgaggaagacagcgaugagccccuggagaggaggcugucccuggugccggacuccgagcagggcgaggccauacugcccaggaucuccgugaucagcaccgggcccacccugcaggcgaggaggcgacaauccguacugaauuugaugacgcacagcgugaaccagggccagaacauccaccguaagaccaccgccagcacgcgcaaggugagccucgcgccccaggccaaccugaccgagcuggacaucuacagcaggcggcuuucccaggagaccggccuggagaucuccgaggagaucaacgaggaggaccugaaggagugcuuuuucgacgacauggagagcauccccgccgugaccaccuggaacaccuaccucagguacaucaccgugcacaagagccugaucuuuguccugaucuggugccucgugaucuuccucgccgagguggccgccucccugguggugcuguggcugcucggcaacacaccacugcaggacaagggcaacagcacccacucccguaauaacuccuacgccgugauaauaaccagcaccagcagcuacuacguuuuuuacaucuacgucgggguggccgauacccugcuggccauggguuucuucaggggccugccccuggugcauacgcugaucaccgugagcaagauccugcaccauaagaugcugcacuccgugcugcaggcccccaugagcacccugaauacccugaaggcaggcggaauccuuaacagguuuuccaaggacaucgccauccuggacgaccuccugccccugaccaucuuugacuucauccaacugcugcugauagucaucggcgcaaucgcagugguggcagugcugcaacccuacaucuucgucgccaccgugccggugaucguggccuuuauaaugcugcgggccuacuuucuccagaccagccaacagcugaagcagcucgagagcgagggcaggagccccauauuuacccaccuggugaccagccugaaggggcuguggacccugagggccuucggcaggcagcccuacuucgagacccuguuccacaaggcacugaaccugcacaccgccaacugguuucuguaccugagcacccugaggugguuccagaugaggaucgagaugaucuucgugaucuucuuuaucgccgucaccuucaucagcauccugacgacgggcgagggcgagggccggguuggcaucauccugacccucgccaugaacaucaugagcacccuccagugggccgugaacagcagcaucgacguggacagccugaugcgguccgucagccgcguguucaaauuuaucgacaugcccaccgaagguaaaccuaccaagucaacgaagcccuauaagaacggccagcugagcaaggucaugaucauugagaauucccacgugaagaaggacgacaucuggccaagcgggggccagaugaccgugaaggaucugaccgccaaguacaccgagggggggaacgccauccuggagaacaucagcuuuagcaucucccccgggcagaggguggggcugcugggccgaaccgggagcggcaagagcacccugcugagcgccuuccuacgccugcucaacaccgagggcgaaauccagaucgacggcgucuccugggacagcaucacccugcagcaguggcgcaaggccuucggcgucauuccccagaagguguuuaucuuuaguggcaccuucaggaagaaccucgaccccuacgaacaaugguccgaucaggaaaucuggaagguggccgacgaggugggccugcggagcgugaucgagcaauucccugguaagcuggacuuuguccugguggacggcggcugcgugcucagccacggccacaagcagcugaugugccuggcccgguccgugcugagcaaagcgaaaauccugcugcuggacgagcccuccgcccaccuggacccggugaccuaccaaaucaucaggcggacgcugaagcaagccuucgccgacugcaccgucauacugugcgaacacaggaucgaggccauguuagagugccagcaguuccuggugauugaggagaauaaggugcgccaguacgacagcauccagaaacugcugaacgagcgaagccuguuccgccaggccaucagccccagcgaccgcgugaagcucuuuccccacaggaacagcagcaaaugcaaguccaagccgcagaucgcggcccucaaggaggagaccgaggaggaggugcaggacacgcgucug

SEQ ID NO: 120 - RNA, 4440 nt, Artificial Sequence
  Synthetic polynucleotide
augcagagguccccccuugagaaggccagcguggugagcaagcuguucuucagcuggaccaggcccauccugcggaagggcuauaggcagaggcuggaacugagcgacaucuaucagauacccuccguagacagcgccgacaaccuuuccgagaagcuggagagggagugggacagggagcuggccuccaagaagaaccccaagcucaucaacgcccugcggagaugcuucuuuuggagguuuauguucuacggcaucuuccuguaccugggcgagguaacuaaagccgugcagccccugcugcucggcaggaucaucgccagcuacgaccccgacaacaaggaagagcgcuccaucgccauauaccucggcauaggccugugccugcuguucaucgugaggacccuccuccugcaccccgcaaucuucggccugcaccacaucgguaugcagaugaggaucgccauguucucacucaucuacaagaaaacgcugaagcuguccuccagggugcuugacaagaucagcaucggacagcuggugagccugcucagcaacaaucugaacaaguucgacgagggccuggcccuggcccauuucguguggaucgccccccugcaggucgcccugcugaugggccucaucugggagcugcugcaggccagcgccuucugcggacucggcuuccucaucgugcuggcgcuuuuucaagccgggcugggccgaaugaugaugaaguacagggaucaacgggccggcaagaucuccgagcggcuugugaucaccagcgagaugauagagaacauccagagcgucaaggccuacugcugggaggaggccauggagaagaugaucgagaacuugcgucaaaccgagcugaagcugacccggaaggccgccuacgugcgauacuucaacucguccgcguucuucuucagcggcuuuuucgugguguuccugagcgugcugcccuaugcccugaucaagggcaucauccugaggaaaaucuucaccaccaucuccuucuguaucgugcugcgaauggccgugaccaggcaguuccccugggccgugcaaaccugguacgacagccugggggccaucaacaagauccaggacuuucugcagaagcaggaauauaagacccuggaguacaaccugaccacuaccgagguggugauggaaaacgugaccgccuucugggaggagggguuuggggaacuguuugaaaaggccaagcagaauaacaacaaccggaagaccagcaacggcgacgacagccuguucuucagcaacuucagccugcucggcacccccguccugaaggacaucaauuucaagaucgagaggggccagcugcuggccgucgcgggcagcacuggcgcgggcaagaccucccugcuaaugguaaucaugggcgagcucgaacccuccgaggggaaaaucaagcacagcgggcggaucagcuucuguucccaauucagcuggauaaugcccgggaccaucaaggagaauaucaucuucggugugagcuacgacgaguaccgguacagguccgugaucaaggccugccagcucgaggaggauaucagcaaguucgccgagaaggacaacaucgugcucggggagggcgguauaacccugagcggcgggcagcgggccaggaucagccuggccagggccguguacaaggacgcggaucuguaccugcuggacagcccguucggguaccuggacgugcugaccgagaaggagaucuucgagagcugcgucugcaagcugauggccaacaaaacccggauccucgucaccagcaaaauggaacaccugaaaaaggccgacaaaauccugauccugcacgaaggcucguccuacuucuacggcaccuucagcgaacugcagaaccuccaacccgacuuuuccuccaagcugaugggcugcgauuccuucgaucaguucagcgccgagaggaggaacagcauacugaccgagacccugcauagguucagccucgagggcgaugcccccguguccuggaccgagaccaaaaaacaguccuucaagcagaccggggaguucggggagaagcgcaagaacagcauccugaacccgaucaacagcauccguaaguucagcauugugcaaaaaaccccccugcaaaugaauggcaucgaggaagacuccgacgagccccuggagcgccggcugagccugguccccgacagcgagcagggggaggcgauccugcccagaaucucugugauaagcaccggccccacgcugcaagcgagacgacggcaguccgugcucaaucugaugacccacucggucaaccagggccagaacauccacaggaagaccaccgccucgacuaggaaggucagccucgcgccccaggccaaccugaccgagcuggacauuuacagccgaaggcugucgcaggagaccggucucgaaauaucugaggagaucaacgaggaggaucugaaggagugcuucuucgacgacauggagagcauccccgccgucaccaccuggaacaccuaccugcgguauaucacggugcacaagagccugaucuucgugcugaucuggugccuggugaucuuccuagccgaggucgccgccucccucguggugcuguggcugcugggaaacaccccccugcaagacaagggcaauuccacccacagcaggaacaacuccuaugccgucaucaucaccagcacgagcagcuacuacguguucuacaucuaugugggagucgccgacacacugcuggccaugggcuucuucagggggcugccccugguccacacgcugaucaccgucagcaagauccugcaccauaagaugcuccacagcguccugcaggcgcccaugucaacgcugaacacccugaaggccggugggauccugaacagguucagcaaggacaucgccauccuggacgaccugcucccccugaccaucuucgacuuuauccagcugcuccugaucgugaucggcgccaucgccgugguggccguccuccagcccuacauuuucguggcgacaguccccgucaucguggccuucaucaugcugcgcgccuacuuccugcagacuagccagcagcugaagcagcuggaaagcgaaggaaggagccccaucuucacccaccucguuacaucacucaagggccuguggacccugagagccuucgggcgccagcccuauuuugagacgcuguuccacaaagcccugaacuugcauaccgccaauugguuccucuaccugagcacccugcggugguuucagaugcgcaucgagaugaucuucgucaucuucuucauagcgguaaccuuuauuuccauccugaccacgggcgagggcgagggccgugugggcaucauccugacccuggccaugaacauaaugucgacccugcagugggcugugaacagcagcaucgacguggacagccucaugaggagcgugagcaggguguucaaguucauugacaugcccacggagggaaagcccaccaaaagcacaaaacccuacaagaauggccaacuaagcaaagucaugaucaucgagaacucccacgugaaaaaggacgacaucuggcccuccggcggacagaugaccgugaaggaccugaccgccaaguacaccgagggcggcaacgcaauacuggagaacaucagcuucucgauaucccccggccagcgcgugggccugcuuggcaggaccggcagcggaaagagcacccugcucagcgcuuuccugaggcuccugaauaccgagggcgagauacagauagauggcgugagcugggacuccaucacccugcagcaguggcggaaggccuucggcgugaucccgcagaaggucuucaucuucuccggcaccuuucguaagaaccucgaccccuacgagcaguggagcgaccaggagaucuggaaggucgcggacgaaguggggcugaggagcgucaucgagcaguuccccggcaagcuggacuucgugcugguggacgggggcugcgugcugagccacggccauaaacagcugaugugccuggcacggagcgugcuguccaaggcgaagauacugcuccuggacgagcccagcgcgcaccuggauccagucaccuaccagaucaucaggaggacccugaagcaggccuucgccgacuguaccgugauccugugcgaacacaggaucgaggccaugcucgaaugccagcaguuccuggugaucgaggagaacaaggugcggcaguacgacagcauccagaaacugcugaacgagcggagccuguuccggcaggccaucagccccagcgauagggugaaacuguucccccaccggaacuccagcaagugcaaaagcaagccccagaucgccgcccugaaggaggagaccgaggaggaagugcaggacaccaggcug

SEQ ID NO: 121 - RNA, 4440 nt, Artificial Sequence
  Synthetic polynucleotide
augcagcgguccccccuggagaaggccuccguggugagcaagcuguucuucucguggaccaggcccauccucaggaagggcuaucgccagcggcuggagcuguccgacaucuaccagauccccucgguggauagcgccgacaaccuguccgagaagcuugagcgggagugggauagggagcuugccagcaagaagaacccgaaacugaucaacgcccugaggcgcugcuucuuuuggcgcuucauguucuacggcauuuuccucuaccucggcgaagugaccaaggccgugcagccccuucuccuggggaggaucaucgccaguuacgaucccgacaacaaagaggagcggagcauagccaucuaccucggaaucggccugugccuccuguucaucgugaggacccugcugcugcaccccgcaaucuucggccugcaccacaucggcaugcagaugcggaucgcgauguucucccugauuuacaagaagacccugaagcugagcagccgcgugcuggacaagaucagcauaggccaacuggugucccugcucuccaacaaccugaacaaguucgacgagggccucgccuuggcccacuucguguggaucgccccgcugcaggucgcccugcugaugggccugauaugggagcugcugcaggccagcgccuucugugggcugggcuuccugaucgugcuggcccuguuucaagccggccugggcaggaugaugaugaaguaccgggaucagcgcgccggcaaaaucuccgaacggcuggugaucaccucggagaugaucgagaauauccagagcgugaaggccuacugcugggaggaggcgauggagaagaugauagagaaucugcgccagaccgagcuaaagcugacccggaaggccgccuaugucagguauuucaauuccagcgccuuuuucuucagcggcuucuuuguuguguuccugagcgugcugcccuacgcccugaucaaaggaaucauucuccggaaaaucuucaccaccaucuccuuuuguaucgugcuuaggauggccgugacccgacaguuucccugggccgugcagaccugguacgauagccugggcgccaucaauaaaauccaggacuuccugcaaaagcaggaauacaagacgcuagaguacaaccugaccaccaccgaggugguaauggagaacguaaccgccuucugggaggagggcuucggggaacucuucgaaaaggccaagcagaauaauaacaacaggaagacguccaacggagacgacucccucuucuucagcaacuucagccugcuggggacccccguccugaaagacaucaauuucaaaaucgagcggggccagcuccuggccguggccgggagcaccggugccgggaagacgagccugcugauggugaucaugggugagcuggagcccuccgaggggaagaucaagcacagcgggcguauaagcuucuguagccaguucucguggaucaugcccggcaccaucaaggagaauaucaucuucggcgugagcuacgacgaguaucgauacaggagcgugaucaaggccugccaacuggaggaggauaucuccaaguucgccgagaaggacaacaucgugcucggcgaggggggcauaacccugagcggcggccagagggcgcggaucagccuggccagggccguguacaaggacgccgaccuguacuugcuggacagcccguuuggguaccucgacgugcugaccgagaaggagaucuucgagagcugcguguguaagcugauggccaacaagaccaggauccuggugacgagcaaaauggagcaucugaagaaggccgacaaaauucugauacugcaugagggcagcagcuauuucuacggaaccuucagcgagcuucagaaccugcagcccgacuucagcagcaagcugaugggcugcgacagcuucgaccaguucagcgccgagcgcaggaauagcauccugaccgagacccugcaccgguuuagccucgaaggagacgcgcccgugagcuggaccgagaccaagaagcagagcuucaagcagacaggcgaguucggcgagaagaggaagaauagcauccugaaccccaucaacagcaucaggaaguucuccaucgugcagaagaccccccugcaaaugaacggcaucgaggaggauagcgaugaaccccucgagaggaggcugagccuggugccggacagcgagcagggagaggccauccugccgaggaucuccgugaucagcaccggccccacccugcaggcccggaggaggcagagcguccucaaucugaugacgcacagcgucaaucagggccagaacauccaccgaaaaacaaccgccuccacccgcaaagugagccuggccccccaggcuaaucugacagagcucgacauauacucccggaggcugagccaagagaccggccuggagaucuccgaagagauuaaugaggaggaccugaaggagugcuuuuucgacgacauggaguccaucccugccgugaccaccuggaacaccuaccugcgguauaucaccgugcacaaguccuugaucuucguccugaucuggugcuuggugaucuuccuggcugagguggccgccucccugguggugcuuuggcugcuggggaacaccccgcugcaggacaaagguaacucuacacacucgcggaacaacuccuaugcggucaucauuacgagcaccuccuccuacuauguguucuacaucuacgugggcguggccgacacccugcuggccaugggcuucuuccguggucugccgcuggugcacacacucaucaccgugagcaaaauccugcaccacaagaugcugcacuccgugcugcaggccccgauguccacccugaacacccuaaaggcuggcggcauccugaacagguucagcaaggacaucgccauccuggacgaccugcugccccugaccaucuucgauuucauucaacugcugcugaucgugauaggcgcgaucgccgucguggccgugcugcagcccuacaucuucguggcgacgguccccgugauaguggccuucauaaugcugagggcuuacuuccugcaaaccucccaacagcugaagcagcucgaguccgagggcaggagccccaucuuuacccaccuggugacgagccugaaggggcucuggacgcugcgggcguucggccgccagccguacuucgaaacccuguuccauaaggcccugaaccugcacaccgccaacugguuccucuaccucuccacccugcggugguuccagaugcggaucgagaugaucuucgugaucuucuucaucgccguaaccuucaucagcauccugaccacuggcgagggcgagggcagggugggaaucauccucacccuugccaugaauaucaugagcacacugcagugggccgugaauagcuccaucgacguggacucccugaugcgguccgugagccgaguguucaaauucaucgacaugcccaccgaggggaagccaacuaaguccaccaagccguacaagaacggccagcugagcaaagugaugaucaucgagaacagccaugugaagaaggacgauauuuggcccagcgggggccagaugaccguuaaagaccugaccgccaaguauaccgagggggggaacgccauucuggagaacaucagcuucuccaucagccccgggcagcgggugggccugcugggccggaccggcagcgggaaguccacacuccuguccgccuuccugaggcugcucaauacggagggcgaaauacagaucgacggcgugagcugggacucaaucacgcugcagcaguggaggaaggcauucggggucaucccgcagaagguguucaucuuuuccggcaccuuccguaagaaccucgaccccuacgagcaguggagcgaccaggaaaucuggaagguggccgacgaggugggccugagguccgugaucgagcaguuccccggcaagcuggacuucgugcucguggacggcgggugcgugcugucccacggccacaagcagcugaugugucuggccaggagcgugcugagcaaggccaagauccugcuccuggacgagcccagcgcucaccuggaccccgugacguaccagaucauccgacgaacccucaagcaggccuucgccgacugcacaguuauccucugcgaacacaggaucgaagccaugcucgagugccagcaguuccuggucauagaggagaacaaggugcggcaauaugacagcauccagaagcugcugaacgagaggagccuguucaggcaggcaaucagucccucggaccgcgugaagcuguuuccccaccggaauagcuccaagugcaagucaaagccccagaucgccgcccugaaggaggagaccgaggaggaggugcaggauacccgccug

SEQ ID NO: 122 - RNA, 4440 nt, Artificial Sequence
  Synthetic polynucleotide
augcagcggagcccccuggagaaggcgagcguggugagcaagcuguucuucagcuggacccgccccauccugcgaaagggcuacaggcagcggcuggaacugagcgauaucuaccagaucccgagcguggauagcgccgacaaccuguccgagaaacuggagagggagugggacagggagcuggcaagcaaaaaaaauccgaagcugaucaacgcccugaggaggugcuucuuuuggcgguucauguucuacgggaucuuccuguaccugggcgaaguaaccaaggccguccagccacugcugcuggguaggaucaucgccagcuacgaccccgacaauaaggaggaaaggagcaucgcgaucuaccugggcaucggccugugccugcuguuuaucgucaggacgcugcugcugcacccggccaucuucgggcuccaccacaucgggaugcagaugcgaaucgccauguucagccugaucuacaagaagacccugaagcuguccagcaggguccuggacaagaucagcauuggccagcuggugagccugcuguccaacaaucugaacaaauucgacgagggccuggcccuggcgcauuucguguggaucgccccccugcaaguggcccugcugaugggccugaucugggagcugcugcaggccagcgccuuuugcggccugggguuccugaucgugcuggcccuguuccaggccgggcucgguaggaugaugaugaaguacagggaccagcgagccggcaaaaucucggagaggcuggugaucaccuccgaaaugauagagaauauucaguccgugaaggccuacugcugggaggaggccauggagaaaaugaucgagaaccugcgccagaccgagcugaagcugaccaggaaggccgccuacgugagauacuucaacucauccgccuucuucuuuuccggcuucuucguggucuuccugagcgugcugcccuacgcccugaucaagggcauaauccucaggaaaaucuucaccaccaucucuuucugcaucgugcugaggauggccgugaccaggcaauuccccugggccguccagaccugguacgauagccugggcgccaucaauaagauccaagacuuccugcagaagcaggaauacaagacccuggaguacaaccucaccaccaccgagguggugauggagaacgucaccgccuucugggaggaaggcuucggcgagcuguucgagaaggcgaagcagaacaacaacaaccgcaagaccagcaauggugacgacucgcucuucuucucaaacuucagccuacugggcacgcccgugcugaaggacauuaacuucaagaucgagcggggacagcugcucgccguggccggaagcaccggcgccggcaagaccagucugcugauggugaucaugggcgagcuggagcccagcgaggggaagauaaagcacagcgggaggaucagcuucugcagccaguucagcuggaucaugcccggcaccaucaaggagaacaucaucuucggcgugagcuacgacgaguacagguaccgaagcgugaucaaggccugccagcuggaggaggauaucagcaaguucgccgagaaggacaacaucgugcugggcgagggcggcaucacgcucagcgguggccaaagggcccggaucucccucgccagggccguguacaaggacgccgaccuguaccugcucgacagccccuucggguaccucgaugugcugaccgaaaaggagaucuucgaguccugcgugugcaagcugauggcgaacaagacccggauucucgugaccagcaaaauggagcaucucaagaaggccgacaagauccugauccugcacgaaggcagcagcuauuucuacggcaccuucagcgagcuccagaaccugcagcccgacuucagcuccaagcucaugggcugcgacagcuucgaucaguucagcgccgaaaggcgcaacuccauccugacggagacccugcacagguucagccucgagggcgacgcccccgucucguggaccgagaccaaaaagcagagcuucaagcagaccggcgaguucggcgagaagcgaaaaaacagcauccugaaccccaucaauagcaucaggaaauucuccaucgugcagaagaccccgcugcagaugaacggcaucgaggaggacagcgacgagccccuggaaaggaggcucagccuggugccggacagcgaacagggagaggccauccugccuaggaucagcgugaucagcaccggccccacacugcaggccaggaggaggcaguccgugcucaacuugaugacccacagcgucaaccaggggcagaacauccacaggaagaccaccgccuccaccaggaaggugagccucgccccgcaagccaaccucaccgagcuggacaucuacuccaggaggcugagccaggagaccggccuggaaaucuccgaggagaucaacgaggaggaccugaaggaguguuucuucgacgacauggagagcauccccgccgugacgaccuggaacaccuaccugagguacaucaccguccacaagucccugaucuuugugcucaucuggugucuggucaucuuucuugcggagguggccgcaagccuggucgugcuguggcugcugggaaacaccccacugcaggacaaggguaacagcacccacagcaggaacaauagcuacgccguuauaaucaccagcaccuccuccuauuauguguucuacaucuauguggguguggccgauacccuguuagccaugggcuuuuuccggggccugccccuggugcacacccuaaucaccgugagcaaaauccuccaccacaagaugcugcauuccgugcugcaggcccccaugagcacccugaacacccugaaggcgggaggcauccucaacagguucuccaaggacauugccauccucgaugaucugcugccccugaccaucuucgacuucauacagcugcugcugauagucaucggcgccaucgccgucguggcggugcuccagcccuacaucuuuguggccacggugcccgugaucguggcguuuaucaugcugcgggccuacuuccugcagaccagccagcagcugaagcaacuggaauccgagggcaggagcccgaucuucacccaccucgugaccucccucaaaggccucuggacccugcgggccuuugggaggcagcccuauuucgagacccuguuccacaaggcccugaaccuccacaccgccaacugguuucuguaccugucgacgcugcggugguuccagaugcgcaucgaaaugaucuucgugauuuucuucaucgccgugacauucaucagcauucugaccaccggcgagggcgaggggagggugggcaucauucugacccuggcaaugaacaucaugucgacccugcagugggccgugaacucaagcaucgacguggacagccugaugagguccguuuccaggguguuuaaauucaucgauaugcccaccgagggcaagcccaccaagagcaccaagcccuauaaaaacggccagcucuccaaagugaugaucaucgaaaacagccacgugaagaaagacgacaucuggcccagcggggggcagaugaccgugaaggaccugacugccaaguacaccgaggggggcaacgccauccuggaaaacaucagcuuuuccaucagccccggccagagggucgggcugcuggggaggaccgggagcggcaagagcacccuccugagcgcguuccugcggcugcugaacaccgagggcgagauacagaucgacgggguaucgugggacagcaucacccugcagcaguggcggaaggccuucggcgugaucccccagaagguguuuauauucagcggcaccuuccgaaagaaccuggaccccuacgagcaguggagcgaccaggagaucuggaagguggccgacgaggugggccugaggucagugaucgagcaguuccccgggaagcuggacuucgugcugguggacggcgggugcgugcucagccauggccacaagcagcugaugugccuggcccgcagcgugcugagcaaggccaagauccuccugcuggaugagcccagcgcccaccuggaucccgugaccuaccaaaucaucaggaggacccuaaagcaggccuucgccgacugcaccguuauccugugcgagcaccggaucgaagccaugcuggagugccagcaguuccuggugaucgaggagaauaaggugcggcaguacgacagcauccaaaagcugcugaacgaaaggagccuguucaggcaggccaucagcccguccgaucgcgugaagcuguucccccacaggaacucauccaagugcaagagcaagccacagaucgcugcccucaaggaggagaccgaggaggaagugcaggacaccaggcuc

SEQ ID NO: 123 - RNA, 4440 nt, Artificial Sequence
  Synthetic polynucleotide
augcagagguccccgcuggagaaggcgucggucgugagcaagcuguucuucuccuggacuaggcccauccugcggaagggcuaccggcagaggcucgagcuguccgacauuuaucagauccccagcguggacagcgccgacaaccugagugagaagcuggagagggagugggaccgggagcuggccagcaaaaaaaacccaaagcugaucaacgcacugaggaggugcuucuucuggcguuuuauguuuuacggcaucuuccuguaucugggagaggucacgaaggccgugcagccccugcugcugggcaggaucaucgcgagcuaugaccccgacaacaaggaggaaaggagcaucgcgaucuaccuggggaucggccugugccugcucuucaucgugaggacccuccugcugcaccccgccaucuucggccuccaccacaucggaaugcagaugaggaucgccauguucagccugaucuacaaaaagacccucaagcuguccuccagggugcuggauaagaucagcaucggccagcuggugagccugcugagcaacaaccugaacaaguucgacgagggccuggcgcuggcccacuucguguggaucgccccgcuccaggucgcccuccugaugggacugaucugggaacuccugcaggccagcgccuucugcggccugggauuccucaucgugcuggcccuguuccaggcuggccucggucggaugaugaugaaguaccgggaccagcgugccggcaagaucagcgaaaggcuggugaucaccuccgagaugaucgaaaauauacagucugugaaagccuacugcugggaggaggccauggagaagaugaucgagaaccugaggcagaccgagcugaagcugacccgaaaggccgccuacgugagguauuucaauuccagcgccuucuucuucagcggcuucuucgugguguuccugagcgugcuucccuacgcccugaucaagggaaucauccucaggaagaucuucaccacgaucagcuucugcaucgugcugaggauggccgugaccaggcaguuucccugggccguucagaccugguacgauagccugggagccaucaauaagauccaggacuuccugcagaagcaggaguacaagacccuggaguauaaccugaccaccaccgaggucgugauggaaaacgugaccgccuucugggaagagggauucggcgagcucuucgagaaggccaagcagaacaacaacaaccggaagaccagcaauggcgaugauucccuguucuucagcaacuucagccugcuggggacccccguacugaaggacaucaacuucaagaucgagagaggccagcugcuggccguagccgggagcaccggggcgggcaaaaccucccuccugauggugaucaugggagagcuggagccguccgagggcaagaucaagcauagcgguaggaucuccuuuuguucccaguucucguggauaaugccgggcaccaucaaggagaacauaauauucggcgucagcuaugacgaguacagguaccguuccgugauuaaggccugccagcuggaggaggauaucagcaaguucgccgagaaggacaacaucgugcuuggcgagggagggaucacccugagcggcgggcagcgugcccggauaucccuggcgagggccguguacaaggacgccgaucucuaccugcuggauagucccuucggguaccuggacgugcugaccgagaaagagaucuucgaguccugcguguguaaacugauggccaauaagaccaggauccuggucaccagcaagauggagcaucugaagaaggccgauaaaauccugauccugcacgagggcagcagcuacuucuacgggaccuuuuccgagcuccagaaccugcagcccgacuucagcagcaagcugaugggcugcgauuccuucgaccaguuuagcgccgagcggcgcaacagcauccugacggagacccugcacagguucagccucgaaggcgacgcgcccguuagcuggaccgagacgaagaagcaguccuucaagcaaaccggggaguucggugaaaagcggaagaacagcauccugaaccccaucaauagcauacguaaguucagcaucgugcagaagacuccccugcagaugaauggcaucgaggaagacuccgacgagccacucgagcggaggcugagccuggugcccgacagcgagcagggagaagccauccuccccaggauuuccgugaucagcaccggccccacccugcaggccaggcggaggcagagcgugcucaaccugaugacccacagugugaaucagggccagaauauccaucgcaagacgacagccucuacccgaaaggucucccuggccccccaggccaaccugaccgagcuggacauauacuccaggcgucugagccaggagacugggcuggagaucuccgaggagauaaacgaggaagaccugaaggagugcuuuuucgacgacauggaguccauucccgcggucacgaccuggaacaccuaccuccgcuacaucacggugcauaaaagccugaucuucgugcucaucuggugucuggugaucuuccuggccgaaguggccgcgagccugguggugcuguggcuccucgggaacacaccgcugcaagacaagggcaacagcacccauagccgaaacaacuccuacgccgugauuauaaccagcaccagcucuuauuacgucuucuacaucuaugugggggucgccgauacccuccuggccaugggcuucuucaggggccugccccugguccauacccugaucaccgucagcaagauacuccaccacaagaugcugcauagcgugcuccaagccccgaugagcacccugaauacucugaaggcaggcggcauucucaacagguucucgaaggacaucgccauccuggacgaccugcucccccugaccaucuucgauuucauccagcugcuccugauagugaucggcgccaucgccgugguggcggugcuccagcccuacaucuucgucgccaccguccccguaaucguggccuucaucaugcugcgcgccuauuuccugcagaccagccagcagcugaagcagcuggaguccgaggggaggagcccaaucuuuacccaccucgugaccagccugaaagggcuguggacccugagggccuuugggaggcaacccuauuuugagacccuguuucacaaggcccugaaccuccacaccgcgaacugguuccucuaucucagcacccugaggugguuccaaaugcggaucgagaugaucuuugugaucuucuuuaucgccgugaccuucaucagcauccugaccaccggggagggcgagggccgcgucggcaucauccugacccucgccaugaacaucauguccacccuccagugggccgugaauagcagcaucgacguggacagccugaugagguccgugucucgaguguucaaguuuaucgacaugccgaccgaggggaagcccaccaagagcacuaagcccuacaagaacgggcagcuguccaaggugaugaucauagaaaacagccacgugaagaaggacgauaucuggccguccggcggccagaugaccgugaaggaccugaccgcgaaguauacggagggcggcaacgccauccucgagaacauaagcuucagcauaagccccggccagcgagugggucugcugggcaggaccgggagcggcaagagcacccugcugagcgccuuccuccgucugcugaacaccgagggggaaauccaaaucgacggcgugagcugggacagcaucacccuccagcaguggcgcaaggccuucggcgugaucccccagaaggucuucaucuucuccggcaccuucaggaagaaccucgaccccuacgagcaguggucagaucaagagaucuggaagguggccgaugaggugggccugaggucagugaucgagcaguuccccggcaagcucgauuuugugcugguggauggugggugcgugcugucccacggccacaagcaacugaugugccuggcaaggagcguccugucgaaggccaagauccugcugcuggacgaacccuccgcccaccuggaccccgugacuuaucagaucauccgaagaacccugaagcaggccuucgccgauuguaccgugauccucugcgagcaccggaucgaagccaugcuggagugccagcaguuccuggugaucgaggaaaacaaggugcgucaguacgacagcauccagaagcugcugaaugagcgcagccuguuccgacaggccaucucccccagcgaccgggugaagcuguucccccaccggaauagcucgaagugcaaguccaaaccccagaucgcagcccuaaaggaggagacggaagaggaggugcaggacacccggcuc

SEQ ID NO: 124 - RNA, 4440 nt, Artificial Sequence
  Synthetic polynucleotide
augcagcgguccccccucgagaaggccagcguggugagcaagcuauucuucagcuggacccgucccauccugcggaagggcuaccgccagcgccuggagcuguccgauauauaccagauccccuccgucgauagcgcggacaaccuguccgagaagcuggagcgugagugggaccgcgagcuggccagcaagaagaaccccaagcugaucaacgcccugcgcaggugcuuuuucuggagguucauguucuacgggaucuuccuguaucugggcgagguuaccaaggccgugcaaccccugcuccucgggcgcaucaucgccagcuacgaccccgauaacaaggaggagaggagcauugccaucuaucugggcauaggccugugccugcuguuuaucgugaggacccugcugcugcaucccgcgaucuucggccugcaccacaucggcaugcagaugaggaucgccauguucucccugauuuacaaaaagacccugaaacugagcucccgcgugcucgacaagaucuccaucgggcaacuggugucccugcugucgaauaaccugaacaaguuugacgaggggcuggcccuugcccacuuugucuggaucgccccgcuccagguggcccuccugauggggcucaucugggagcugcugcaggccagcgccuuuugcggccugggcuuucugaucguacucgcccucuuccaggccggucuaggccggaugaugaugaaguaccgagaccaacgggccggcaagaucuccgagaggcuggucaucaccagcgaaaugaucgagaauauccagagcgugaaagcuuacuguugggaagaggccauggaaaagaugaucgagaaccugcggcaaaccgagcugaagcugaccaggaaggccgcguacguccgguacuucaacagcagcgccuucuucuucuccggcuucuucgugguguuccugagcgugcugccuuacgcccugaucaaggggaucauccucaggaagaucuucacgaccaucuccuuuugcauaguccugcgcauggccgugacccgccaguuccccugggccgugcagacgugguacgacagccugggggccaucaacaagauccaggacuuccugcaaaagcaagaguacaaaacccuggaauauaaccugaccaccaccgaagucgucauggagaacgugacagccuucugggaggagggcuucggcgagcucuucgaaaaggccaagcaaaacaacaacaacaggaagaccuccaauggcgacgacagccuguucuucagcaacuucagccugcucgggaccccggugcugaaggacauuaauuucaaaaucgagcggggccagcugcuggccguggccggcuccacaggggcuggcaagaccagccuccugauggugaucaugggggaacucgagcccuccgagggcaagaucaagcacuccggcaggaucagcuucugcagccaguuuagcuggaucaugcccggcaccauuaaagaaaacaucaucuucggggugagcuacgacgaauacagguacaggagcgugaucaaggccugccagcuggaggaagauaucuccaaauuugcggaaaaggauaacauugugcugggcgaaggcgggaucacucucagcgguggucagcgcgcccggauaagccuggcgcgcgccguguacaaggacgccgaccuguaucugcuggacucccccuucggcuaccuggacgugcucaccgagaaggagaucuucgaguccugcgugugcaaacucauggccaacaagaccaggauccucgucacgagcaagauggagcaccugaaaaaggccgacaagauccugauccugcaugagggcagcagcuacuucuauggcaccuucagcgagcugcagaaccugcagcccgacuucagcucuaagcugauggggugcgauaguuucgaccaauucagcgccgagaggaggaauagcauccugacggaaacccuccacagguucagccuggagggcgacgcaccggugagcuggaccgaaaccaagaagcaaagcuucaagcagaccggggaguuuggggagaagaggaagaacagcauccugaaccccauaaacuccauccgcaaguucaguaucgugcagaagaccccgcugcaaaugaacggcaucgaagaggacagcgaugagccccuggaacggaggcugucucuggugccggacagcgagcagggcgaggcaauacugccccgcaucagcgugaucuccacuggcccgacgcugcaagcccggcggcgccagucugugcucaaccucaugacccauagcgugaaccagggccagaacauccaccgcaaaacgaccgccagcacgcguaaggugucccuggccccgcaagccaaccucaccgagcuggacaucuacucccgaaggcugagccaggagacaggucuggagaucucggaggagaucaaugaagaggaccuuaaggagugcuucuucgacgacauggaaagcauccccgccgugaccacguggaacaccuaccugagguacaucaccgugcacaagagccugaucuucgugcugaucuggugccuggugaucuuccuggccgagguggcggccagccugguggugcuguggcugcucggcaacaccccccugcaggacaagggcaacuccacccacagcaggaacaacagcuacgccgugaucaucaccagcacguccagcuacuacgucuucuacaucuaugugggcguggcugacacccuucuggccaugggcuucuuucgcgggcugccccugguccacacccucauaacgguguccaagauccugcaccacaaaaugcugcacagcgugcugcaggcccccaugagcacccugaacacccucaaggccggcgggauucugaaccgguucagcaaggauaucgccauccuggacgaccugcugccccugaccaucuucgacuucauccagcugcugcuuaucgugaucggcgcuaucgccgugguggccguacugcagcccuacaucuucguggcgacggugccagugaucgucgccuucaucaugcugagggccuacuuccuucagaccagccaacagcugaagcagcuggagagcgaggggcgcagccccaucuucacccaccuggucaccagccugaagggucuguggacccugagggccuuuggccggcagccguacuucgagacccuguuccacaaagcccucaaccugcauaccgcaaacugguuccucuaccucuccacccugcggugguuccagaugcggaucgagaugaucuucgugauuuucuucaucgccgugaccuuuaucagcauccugaccaccggugagggcgaggggcgggucgggaucauccugacccuggccaugaacaucauguccacccugcagugggccgucaacagcuccaucgacguagacagccugaugaggagcgucuccaggguguucaaguucaucgacaugccgacggagggcaagccgaccaaauccacgaagcccuacaagaacggccagcucagcaaagugaugaucaucgagaacucccacgugaagaaggacgauaucuggcccagcggcggacagaugaccgugaaggaccugacggccaaguacaccgaaggcggcaacgcuauacuggaaaacaucagcuucagcauuagcccggggcagagggugggccugcugggccggaccggaagcggcaagagcacccugcuguccgccuuccugcggcugcugaacaccgagggggaaauacagauagacggcgugagcugggacagcaucacccugcagcaauggcggaaggccuucggcgucaucccccaaaaggucuucaucuucuccggcaccuuuagaaagaaccuggaccccuacgagcaauggucagaccaggagaucuggaagguggccgaugaggugggccugcggagcgugaucgagcaguuccccggcaagcuggacuucgugcugguggacggcggcugcguccugagccacggccacaagcaacugaugugccucgccaggagcguccugucaaaggcuaagauccugcuccucgacgagcccagcgcccaccuugaccccgugaccuaccagaucauccggaggacgcugaagcaagccuucgccgauugcaccgucauccugugcgagcacaggaucgaggccaugcuggaaugccaacaauuucuggugaucgaggagaacaaggugaggcaguacgacuccauccagaagcugcugaacgaaaggagccuguuuaggcaggccauaagccccagcgauagggucaagcucuucccgcacaggaacagcaguaaaugcaagucaaagccccagaucgccgcccugaaggaggaaaccgaggaggaggugcaggacacccgccug

SEQ ID NO: 125 - RNA, 4440 nt, Artificial Sequence
  Synthetic polynucleotide
augcagcggagcccccuggagaaggcauccgucgugucuaagcuguucuucagcuggaccagacccauccugcggaagggcuaccggcagcggcucgagcugagcgacaucuaccagauccccuccguggacagcgccgacaaccugagcgagaagcuggagcgagagugggacagggagcuggccagcaagaaaaaccccaagcugaucaacgcccugcgccgcugcuucuucuggcgguucauguuuuauggcaucuuucuguaccugggcgaagugacgaaggccgugcagccccugcugcugggccguauuaucgcgagcuaugaucccgacaacaaggaggagaggagcaucgccaucuaccugggcaucggccugugccuccuguucaucguacgcacccuguuacugcaccccgccaucuucggccugcaccacauugggaugcagaugcggaucgccauguucagccugaucuacaagaagacccugaagcugaguuccagggugcuggacaagaucagcauaggccagcuggugucccugcucagcaacaaccucaacaaguuugaugagggccuggcccuagcccauuucguguggaucgccccgcugcagguggcccugcugaugggccugaucugggagcugcugcaagccagcgccuucugcggccuaggguuccugaucgugcuggcccuguuccaggcgggccugggcaggaugaugaugaaguaccgcgaccagagggcugggaagaucagcgagaggcuggucauuaccucagaaaugaucgagaauauccaguccgugaaggccuacugcugggaggaggccauggagaaaaugaucgagaaccucaggcagaccgaacugaagcugacacggaaggccgccuacgugagguacuucaacagcagcgcguuuuucuucucgggcuucuuugugguguuccuguccgugcugccguacgcccucaucaagggcaucauacugcggaagaucuuuaccaccaucagcuucuguaucgugcugaggauggccgugaccaggcaguuccccugggccguccagaccugguacgacagccugggugccauuaauaagauccaagacuuccugcagaagcaggaguacaagaccuuggaguacaaccucaccacuaccgagguggucauggagaacgugaccgccuucugggaggagggcuucggcgagcuguuugaaaaggcgaaacagaacaauaacaaccgcaagaccagcaacggcgacgacucccuguucuuuagcaacuucagucugcugggcaccccggugcugaaggacaucaacuuuaagaucgagaggggacagcugcucgccguggccgguagcaccggcgccggcaagaccagccugcugauggugaucaugggcgagcuggagcccagcgagggcaaaauaaagcacagcggcaggaucagcuuuuguagccaguucagcuggaucaugcccggcaccaucaaggaaaacaucauuuucggcgugagcuacgacgaauacagauacagaagcgugaucaaggccugccaacuggaggaagacaucagcaaguucgccgagaaggacaauaucgugcucggcgagggcggcaucacccugagcggcggccagagagcccgcaucucgcuggccagggccgucuacaaggacgccgaucuguaucugcuggacagccccuucggcuaccuggacgugcugaccgaaaaggagaucuucgagagcugcguguguaaacugauggccaacaaaacccggauccuggugacgagcaagauggagcaucugaagaaggccgacaaaauccugauacugcacgaggggagcagcuacuucuacggcaccuucagcgagcugcagaaucugcagcccgacuuuagcagcaaacugaugggcugcgacagcuucgaccaguucucggccgaacggcguaauuccauccucaccgagacccugcacagguucucccuggagggcgacgcccccguguccuggaccgagaccaaaaagcagucauucaagcaaaccggugaguucggcgagaagcgaaaaaacucuauccugaaccccaucaacagcauccgcaaauucagcaucguccagaagaccccacuccagaugaacgggaucgaggaggacuccgaugagccccuggagaggaggcucagccuggugcccgacuccgagcagggggaggccauccugcccaggaucucggucaucagcaccgggcccacccugcaagccaggcggcgacagagcguccugaaccugaugacccacagcgugaaccagggccaaaauauccacaggaagaccaccgcaagcacccgcaaggucagccuggcgccccaggccaaccugacggagcucgacaucuauuccaggcggcugagccaggagaccggccuggagaucuccgaggagaucaaugaggaggaccugaaagaaugcuucuucgacgacauggagagcauccccgccgugacgaccuggaauaccuaccuccguuauaucaccgugcacaagagccugaucuucgugcugaucuggugccuggugaucuuccuggccgaggucgccgcaucgcugguggugcuguggcugcuggggaacaccccgcugcaggacaagggcaacuccacccacagcaggaacaauagcuacgccgugaucaucaccagcaccagcagcuacuauguguucuacaucuacguggguguggccgacacccugcuggccaugggcuucuucagaggccuaccccuagugcacacccugaucaccgucucgaagauccuccaccacaagaugcugcacagcgugcugcaagcccccauguccacccucaauacccugaaagccggcggaauccucaaccgauuuuccaaggacaucgccauacuggaugacuuacugccuuugaccaucuucgacuucauccagcugcugcugaucgugaucggggccaucgccgucguggccguccugcagcccuacaucuucguggcaacggugcccgugaucguagcguuuauuaugcuccgggccuacuuccugcagacgucccagcagcucaagcaacuggaaucagagggcaggucccccaucuucacccaccuggugaccucccucaaaggacuguggacccugagggcguucgggcgccagcccuacuuugagacccuguuccacaaggcccucaaccugcacaccgccaacugguuccuguaucucuccacccugcggugguuccagaugcggaucgagaugauauuugucaucuuuuucaucgccgugaccuuuaucagcauccucaccaccggcgagggcgagggccgugucggcauuauccugacccuggcaaugaacaucaugagcacccugcagugggccgugaauuccuccaucgacguggacagccugaugaggagcgucagcaggguguucaaguucaucgacaugcccacggagggcaagccgaccaagucgaccaagcccuacaagaacggccaacugagcaaggugaugaucaucgaaaacagccaugugaagaaggacgacaucuggcccagcgggggccagaugaccgugaaggaccugacugccaaguacaccgaggggggcaaugccauacuggagaacaucagcuucuccaucagcccuggacagagggucggccugcuggggcggaccgguucgggcaagagcacccuucugagcgccuuccugcgacugcuuaacaccgaaggcgagauucagauagacggcgucagcugggacuccaucacccuccagcaguggaggaaggccuuuggggugaucccccagaagguguucaucuucagcggaaccuuccguaagaaccuggacccauacgagcaguggagcgaccaagagaucuggaagguggcggacgaagucggccugaggagcgugaucgagcaguuucccggcaaacucgacuucgugcugguggacggcgggugcgugcugagccacggccacaaacaacucaugugccuggcccggagcgugcuguccaaagccaagauccugcugcuggacgagcccagcgcccaccuggaccccgucaccuaccagaucaucaggaggacucugaagcaggcguucgccgacugcaccgugauccugugugagcacaggaucgaggccaugcuggagugccagcaguuccuagugaucgaggagaacaaggugaggcaguaugacagcauccagaagcugcuaaacgaacgcucccuguuuaggcaggccaucucccccagcgaccgugugaagcuguucccccacaggaauuccuccaaaugcaagagcaagccgcagaucgccgcgcugaaggaggagaccgaagaggaaguccaggauacgaggcug

SEQ ID NO: 126 - RNA, 4440 nt, Artificial Sequence
  Synthetic polynucleotide
augcagaggagccccuuagagaaggccuccgugguguccaagcuguuuuucagcuggaccaggccgauacucaggaagggcuacaggcagaggcuggagcucagcgacaucuaccagaucccgagcguggacucggcggauaaccugagcgagaagcuggagcgagagugggaccgagagcuggccagcaaaaagaaccccaagcugaucaacgcccugagacggugcuucuucuggcgguuuauguucuacggcaucuucuuguaccucggggagguuaccaaggccgugcagccccuccugcucggccguaucaucgcaagcuacgaucccgacaacaaggaggaaaggagcaucgccaucuaucugggcaucggccucugccuccuguucaucguuaggacacugcugcugcaucccgccauuuucggccugcaccacaucgggaugcagaugaggaucgccauguuuucccugaucuacaagaagacccugaagcugucgagcagggugcuugacaagaucuccaucggccaacuggugucccugcucuccaacaaccugaacaaguucgacgagggccuggcccuggcccacuucguguggaucgccccccugcagguggcgcugcugauggggcugauuugggagcugcugcaggccagcgccuucugcgggcugggcuuucucauuguguuggcccuguuccaggccggccucggccgcaugaugaugaaguaccgcgaucagagggccgggaagaucuccgagcgccucgugaucaccucggaaaugaucgagaacauccagagcgugaaggccuauuguugggaggaagccauggagaagaugaucgagaaccugaggcagacggagcucaagcucacccggaaggcggccuaugugagguacuucaacagcuccgccuucuucuucagcggguuuuucgugguguuccugagcgugcugcccuacgcccugaucaagggcaucauccugcggaagaucuucaccaccauuagcuucugcaucgugcugcggauggccgugacccggcaguuccccugggccgugcagaccugguacgauagccugggcgccaucaacaaaauccaggacuuccugcagaagcaggaguacaagacccucgaguacaaccugaccaccaccgaggucgugauggagaacgugaccgccuuuugggaggaggguuucggcgagcuguucgagaaagccaagcagaacaacaacaacaggaagaccagcaacggcgacgacucccuguucuucagcaacuuuagccuccugggcacccccgugcugaaggacaucaauuucaagaucgagaggggccagcugcuggccguggccgguagcaccggcgccgggaaaaccagccugcugauggugaucaugggcgagcuggagcccagcgagggaaagaucaaacacagcgggaggaucuccuucugcucccaguucagcuggaucaugccgggcaccauaaaggagaacauaaucuucggcgucagcuacgacgaguaccgauacaggagcgucaucaaagccugccagcucgaggaggacaucuccaaguucgccgagaaggauaacaucgugcugggcgaggggggcaucacgcuguccggcggucagagggccaggauuucccucgcuagggccguguauaaggaugccgaccucuaucugcuggacagccccuuugguuaccuggacgugcugaccgaaaaggaaauuuucgagagcugcgugugcaagcugauggccaacaagacgcgcauacuggucaccagcaagauggagcaucugaagaaggccgacaagauccugauccugcacgagggcagcagcuacuucuacgggacauucagcgagcugcagaaccuacagcccgacuucagcucgaagcugauggggugcgacagcuucgaucaguucagcgccgaacgccgcaauuccauccugaccgaaacccugcauagguucucucuggagggcgacgcccccguguccuggaccgaaaccaagaagcagagcuucaagcaaaccggggaguucggcgagaaaaggaagaacagcauccugaaccccaucaauagcaucaggaaguucagcaucgugcagaaaaccccccugcagaugaacggcaucgaggaggauuccgacgaaccccucgagaggcggcugagccuagugcccgacuccgagcagggggaagccauacugccccgcaucagcgugaucuccaccggccccacccugcaggccaggcggaggcagagcgugcugaaccugaugacgcacagcgugaaccagggccagaacauccacaggaagacgaccgccagcacccggaaggugucgcucgccccccaggccaaucugaccgagcuggacaucuacagccggcggcugucgcaggagacggggcuggagaucagcgaggagaucaacgaggaggaccugaaggagugcuucuucgacgacauggaguccauccccgccgucaccacguggaacaccuaccuuagguacaucaccgugcacaaaucccugauauucgugcugaucuggugcuuggugaucuuccucgccgagguggccgccagccuggugguccuguggcuccugggcaacaccccacugcaggauaagggcaacagcacccacucccgcaacaacagcuacgcggugaucaucacaagcacgagcagcuacuacgucuuuuacaucuacgucggggucgccgacacccuccuggccaugggcuucuuucgcgggcugccccuggugcacacccugaucaccgugagcaagauucuccaccacaagaugcugcacuccgugcugcaggcccccaugagcacccugaacacccugaaggccgguggcauccugaaucgguucagcaaggauaucgccauacuggacgaccugcugccccugaccaucuucgacuucauucagcuccuacugaucgugaucggcgccaucgccgucguggccguccugcagccguacaucuucguggcaacggugcccgugaucguggccuuuaucaugcugcgggccuacuuccuccagaccucccagcagcucaagcagcuggagagcgaggggcgcagccccaucuucacccaccuggugaccucccugaaaggccuguggacccucagggccuucgggcggcagcccuauuucgagacccucuuucacaaagcccugaaccugcacacugccaacugguuccuguaucugagcacccugcgcugguuccagaugaggaucgagaugaucuucgugaucuucuucaucgccgugaccuuuaucagcauucucaccacaggagaaggggagggccgcgugggcaucauucucacacucgccaugaacaucaugagcaccuugcaaugggccgugaacagcagcaucgacguggacagccugaugaggagcgugucccgcguguuuaaguucaucgacaugccgaccgagggcaagcccaccaagagcaccaagcccuauaagaacggccagcugagcaaggugaugaucaucgagaacagccacgucaagaaggacgacauauggccaagcggcggacagaugaccgugaaggaccugaccgccaaguacacggagggaggcaacgcgauccuggagaacaucagcuucagcaucucccccggccagcgcgugggccugcucggcaggaccggcagcggcaagagcacccuacucuccgcguuucugcggcugcugaacaccgagggcgaaauccagaucgacggagugagcugggacagcaucacccugcagcaauggaggaaggccuucggggugaucccccagaagguguucaucuucagcgguaccuucaggaaaaaccuggaucccuacgagcaguggagcgaccaagagaucuggaagguggccgacgagguggggcugcguuccgugaucgaacaguuucccggcaaacucgacuucgugcuggucgacggcggcugugugcucagccacggccauaagcagcugaugugccuggccagguccguccucagcaaggccaagauccugcuccuggacgagcccuccgcccaccuggaccccgugaccuaccagaucaucaggaggacccugaagcaggccuucgccgacugcacugugauccucugcgagcacagaaucgaggccaugcucgaaugccagcaguuccuggugaucgaagagaacaaggugaggcaguacgauuccauccagaagcugcugaacgagaggagccuguucaggcaggccaucagccccagcgauagggugaagcuguucccccaucggaacuccuccaagugcaagagcaagccacagaucgccgcgcugaaggaggagaccgaggaggaaguccaggacacccggcug

SEQ ID NO: 127 - RNA, 4440 nt, Artificial Sequence
  Synthetic polynucleotide
augcagagguccccccuggagaaagccuccgugguuuccaagcucuucuucagcuggacccgccccauccugaggaagggcuaccggcagcgccuggagcugagcgacaucuaccagaucccgagcgucgacagcgccgacaaccugagcgagaagcuggagcgggagugggaucgggagcucgccuccaagaaaaaccccaagcugaucaacgcccugaggcggugcuucuucuggcgguucauguuuuacggcaucuuccuguaccugggagaggucacgaaggccgugcagcccuugcugcugggaaggaucaucgccagcuacgaccccgacaacaaggaggaaagguccauugcgauauaucugggaaucggccugugucugcuguucaucguaaggacccuccugcuccaucccgccaucuucgggcuccaccacaucggcaugcagaugaggaucgccauguuuagccucaucuacaaaaagacccugaagcuguccuccagagugcuggauaagaucuccaucggccaacuggugucccuccugagcaacaaccugaacaaguucgacgagggccuggcccuggcccauuucguguggaucgccccccuccagguggcgcuccugaugggccugaucugggagcugcugcaggccagcgccuuuugcggacugggguuucugaucguuuuggcccuguuccaggccggacugggcaggaugaugaugaaguaccgggaucaaagagcgggaaagaucuccgagaggcuggucauaaccagcgaaaugaucgagaauauccaaagcgugaaggccuacugcugggaggaggccauggagaagaugaucgagaaccugcgccaaaccgaacucaagcugacccgaaaggcggccuacgugcgguauuucaauagcagcgccuucuucuucagcggcuucuucgucgucuuccucuccguccugcccuacgcccugaucaaggggaucauccugaggaagaucuuuaccaccaucucguuuugcaucgugcugcgaauggccgugaccaggcaauuccccugggccgugcagaccugguacgacucccugggagccaucaacaaaauccaagacuuucugcagaagcaggaguacaaaacccuggaguacaaccugaccaccacggaggucgugauggagaacgucaccgccuucugggaggagggcuuuggcgagcuguucgagaaggccaagcagaacaacaacaauaggaaaaccagcaacggcgacgauagccuguucuucagcaacuucucccugcuggggacgcccguccugaaggacauaaacuucaagaucgagaggggccagcugcuggccguggccggcagcaccggcgccgggaagacgagccuccugaugguaaucaugggcgagcuggagcccuccgaaggcaagaucaagcauuccggcagaaucagcuucugcucccaguucucguggauuaugcccggcacgaucaaagagaacaucauauucggcguguccuacgacgaguaccgguacaggagcgugaucaaggcgugccagcuggaggaagacaucagcaaguucgccgagaaggacaacaucgugcucggcgagggcggaaucacgcugagcggcggacagagggcccgcaucagccuggcuagggccguguacaaagacgccgaccuguaccugcuggacagccccuucgguuaccucgacgugcugacggagaaggagaucuucgaguccugugucugcaagcugauggccaauaagaccaggauccuggugaccagcaagauggagcaccugaagaaggccgacaagauacugauccuccacgagggcuccucguacuucuacggcaccuucuccgagcugcagaaccugcagcccgauuucagcagcaaacugaugggcugugacuccuuugaucaguucagcgccgagaggcggaauagcauccugaccgagacccugcaccgguucucucuggaaggugaugcccccgugagcuggaccgagaccaagaagcagagcuucaagcagaccggcgaguuuggcgagaagaggaagaacagcauccugaaucccaucaacagcauccggaaguucagcaucgugcagaaaaccccccuccagaugaacggcaucgaggaggauagcgacgagccccuggagaggcggcucagccuggugcccgacagcgagcagggggaggccauccugcccaggaucagcgucaucagcacuggccccacccugcaagcccggcggaggcaaagcgugcuaaaccucaugacccacuccgugaaccaggggcagaauauccaucggaagaccaccgccagcacccggaaggugagccuggcaccgcaggccaaccugaccgagcuggauaucuacagccgacggcugagccaggaaaccggacucgagaucagcgaggagaucaacgaggaggaccugaaggagugcuucuucgacgacauggagagcauccccgccguuaccaccuggaacaccuaccugcgcuacaucaccgugcacaaaagccugaucuuugugcugauauggugccuggugaucuuucuggccgagguggccgccagccugguggugcuguggcuacugggcaauaccccccugcaggauaagggcaacagcacccacagcaggaacaacagcuacgccgugaucaucaccagcaccuccagcuacuacgucuucuauaucuacgugggcguggcggacacccugcuggcuaugggguucuuucggggccugccacuggugcacacccugauaaccgucagcaagauccugcaucacaagaugcugcacagcguccugcaagcucccaugagcacccugaacacccucaaagccggcggaauccugaaccgcuucagcaaggacaucgccauccuggacgaucugcugccccucaccaucuucgauuuuauccagcuccugcugaucgugaucggcgcgauugcagugguggccgugcugcagcccuacaucuucguggccaccgugccggugauuguggccuucaucaugcuccgggccuacuuccugcagaccagccagcagcugaagcagcucgagagugaaggccgcagccccaucuucacccaccuugugaccagccugaagggccuguggacccugagggccuucgggaggcaacccuacuucgagacgcuguuucacaaggcccucaaccuccacaccgccaacugguuccucuaccugagcacccugcgcugguuccaaaugaggauagaaaugaucuucgugauauucuucaucgccgugaccuuuaucagcauacugaccaccggcgaaggcgagggcagggucgggaucauccugacccucgccaugaacaucauguccacccugcaaugggccgugaacuccagcaucgacguggacagccugaugaggagcgucagccgcgucuucaaguucaucgacaugcccaccgagggcaagcccaccaagagcaccaagcccuacaagaacggccagcugagcaagguuaugaucaucgagaacagccacgucaagaaagacgauauauggcccagcggcggccagaugaccgucaaggaccugaccgccaaguacaccgaaggcggcaacgccauccuggagaacaucagcuucagcauuagccccggccagcgagugggccugcucggaaggaccggcagcgggaagagcacccugcugagcgcguuucugaggcuguugaacaccgagggcgaaauccagaucgauggcgugagcugggacagcaucacccuccaacaguggaggaaggccuucggcgugauuccccagaagguguucaucuuuagcggcaccuucaggaagaaccucgaccccuacgagcaguggagcgaccaagagaucuggaagguugccgacgaggugggccucaggagcgugaucgagcaauuucccggcaagcuggacuucgugcugguggacgggggcugcgugcugagucacgggcacaagcagcugaugugccuggcccgguccgugcugagcaaggccaagauccuccugcuggacgagcccuccgcgcaccuggaucccgugaccuaccagauuauccggaggacccugaagcaggcauuugccgacugcaccgugauccugugcgagcaccguaucgaggcgaugcuggaaugccagcaguuucuagugaucgaagagaacaaagucaggcaguacgacuccauccagaagcuucugaacgagaggagccuguuccggcaggccaucucccccuccgaccgcgugaagcuguucccccaucggaacuccagcaagugcaagagcaagccccagaucgccgcccugaaggaggagaccgaggaggaggugcaggacaccaggcuc

SEQ ID NO: 128 - RNA, 4440 nt, Artificial Sequence
  Synthetic polynucleotide
augcagagguccccgcuggagaaggccuccgugguguccaagcuguucuucuccuggacccggcccauccuccggaagggcuaucggcagaggcuggagcugagcgacauuuaccagaucccaagcgucgacagcgccgacaaccugagcgagaagcuggagcgggagugggaccgugagcuggcaaguaagaagaaccccaagcugauaaaugcccugaggcgauguuuuuuuuggagguucauguucuacggcaucuuucucuaccucggagaggugaccaaggccgugcagccccugcugcuggggcggaucaucgccagcuacgaucccgacaacaaggaagagagguccauagccauuuaccugggcaucgggcucugccuccucuucaucguccgcacccugcugcugcaccccgccaucuucgggcugcaccacaucggcaugcaaaugcgcaucgccauguucucacugaucuacaaaaagacgcugaagcugagcagcagggugcuggacaagaucuccaucgggcaacuggugagccuccuguccaacaaccugaacaaguucgacgagggacuggcccuggcccacuucguguggaucgccccccuccagguggcccugcugauggggcucauaugggagcuucugcaggccagcgccuucuguggccugggguuucugaucgugcuggcccuguuucaggccggucucggccgaaugaugaugaaguacagggaccaaagagcgggcaagaucuccgagcgacuggugaucaccuccgagaugaucgagaacauccagucggugaaagccuacugcugggaggaggccauggaaaagaugaucgagaaccucaggcagaccgaacugaagcucaccaggaaggccgccuacgugcgguauuucaauucgucagccuucuucuuuagcggcuuuuuugugguguuccucucugugcugcccuaugcacugaucaagggaaucauccugaggaaaaucuucaccaccaucagcuucuguaucgugcuccgcauggccgugaccaggcaguuccccugggccgugcagaccugguacgacucccugggggccaucaauaagauccaggauuuccugcagaaacaggaguacaaaacccuggaguauaaucugaccaccacugaggugguaauggagaacgucaccgccuucugggaggagggcuucggcgagcuguucgagaaggccaagcaaaacaauaacaacaggaagacgagcaacggggaugacagccucuucuucagcaacuuuucccugcuggggacucccguccugaaggauaucaacuucaagaucgaaaggggacagcugcuggccgucgccggcagcaccggggccggcaagacaagccugcugauggucaucaugggcgaacuggagccuagcgagggcaagaucaaacacagcgggaggaucuccuucugcucccaguucagcuggaucaugcccggcaccaucaaggagaacaucaucuucggggucagcuacgacgaguaccgcuaucgcagcgugaucaaggccugucagcucgaggaggacaucagcaaauucgccgagaaggacaacaucgugcucggcgagggcgggaucacccucagcggcgggcaacgggcccggaucagccucgccagggccguguacaaggaugcggaccuguaccugcuggacagccccuucggcuaccuggacgugcucaccgagaaggagaucuucgaguccugcguguguaagcucauggcgaacaagaccaggauccucgugaccagcaagauggagcaucugaaaaaggcggacaaaauccuuauccugcacgagggguccuccuauuucuauggcaccuucuccgagcuccagaaccugcagccggacuucagcuccaagcugaugggcugcgauagcuucgaccaguucuccgccgagcgcaggaacuccauacucaccgagacgcugcacagguucucgcucgaaggcgacgcccccguguccuggaccgagaccaagaaacaguccuuuaagcagaccggcgaguucggagagaagaggaagaacagcauccugaaccccaucaacuccaucaggaaguuuagcaucgugcaaaagaccccgcuccagaugaauggcaucgaggaagacuccgacgaaccccucgagcgccggcugagccuggugccggauagcgagcaaggggaggccauccugccccgcaucuccgugaucuccaccgggcccacgcugcaggccaggcggaggcagagcgugcugaaccugaugacccacucugugaaccagggccagaacauacaccggaagaccaccgccucgacccgcaaggugagucucgccccccaggcaaaccucaccgagcuagauaucuauagcaggaggcugagccaggagacgggccucgagaucagcgaggaaauaaaugaagaggaccugaaggagugcuucuucgacgauauggagagcauaccggccgugacgaccuggaauaccuaccugagguacaucaccgugcacaaaucgcugaucuucgugcugauuuggugccugguaaucuuccuggcugagguggccgccucccucguggugcuguggcugcucggcaacacgccccugcaggacaagggcaacagcacccauuccaggaacaauucguaugccgugaucaucaccuccaccagcagcuauuacguguucuacauuuacguggggguggccgacacccugcuggccaugggguucuucagagggcugccacugguccacacccugauaaccguguccaagauccugcaccacaagaugcugcacagcgugcugcaggcccccaugagcacgcugaacacgcuuaaggccggcgguauccugaaccgcuucuccaaggacaucgccauccucgacgaccugcucccccugaccaucuucgacuucauccagcugcugcucaucgugauaggcgcaaucgccgugguggccgugcuucagccguacaucuucguggccacggugcccgugaucguggccuucaucaugcugagggccuacuuccuccaaaccagccagcagcugaagcaacuggaguccgagggccggagccccaucuucacccaccucgugaccagccugaaaggccuguggacccugagggccuucggccggcaacccuauuuugagacccuguuucacaaggcccucaaucuccauaccgccaauugguuccucuaccugagcacccugaggugguuucagaugcguaucgagaugauuuucguaauauucuucaucgccgugaccuucaucuccauccugaccaccggcgagggagaaggccgcguggggaucauccugacccucgccaugaacaucaugagcacccugcagugggccgugaacuccagcaucgacgucgacucccugaugcgcagcguguccaggguguucaaguucaucgacaugccaacugagggcaagcccaccaagagcacgaagccauauaagaacgggcaacugagcaaggugaugaucaucgagaacagccacgucaagaaggacgauaucuggcccagcgggggccagaugaccgugaaggaccucaccgccaaauauaccgagggggguaacgccauccuggagaacaucagcuucuccaucagucccgggcagcgggucggccugcucggccgaaccggcagcgggaagagcacgcugcucuccgcguuccugcggcugcugaacaccgagggcgagauucagaucgacggggucuccugggauagcauuacccugcagcaguggcggaaggcguucggcgucaucccccagaagguguucaucuucucgggcacguucagaaagaaucuggaucccuacgagcaguggagcgaccaggagaucuggaagguggccgacgaagugggccuaaggagcgugauagaacaguuccccggcaagcuggauuuugugcuggucgauggcggcugcgugcugagccacgggcacaagcagcugaugugccuggcccggagcgugcugagcaaggccaagauccugcugcuggacgagcccuccgcccaccuggacccggugaccuaccagaucaucaggaggacccucaagcaggccuucgccgacugcaccgucauccucugcgaacaccgaaucgaggccaugcucgagugccagcaguuccuggugaucgaggagaacaaggugcgccaguacgacagcauccagaagcugcucaaugaacggagccucuuuaggcaggccaucagcccgagcgacagggucaagcuguuuccccaccgcaacagcuccaaaugcaaaagcaagccccagaucgcggcccugaaggaagagaccgaggaagaggugcaggacaccaggcuc

SEQ ID NO: 129 - RNA, 4440 nt, Artificial Sequence
  Synthetic polynucleotide
augcagagguccccccuggagaaggccuccguggugagcaagcuguucuucagcuggacccggcccauccugaggaaaggcuacaggcagcgacucgagcuguccgacauauaccaaauccccagcguggacagcgcggacaaccugagcgagaagcuggagcgcgagugggacagggagcucgccagcaagaaaaaucccaagcuuaucaacgcccugaggcguuguuuuuucuggcgcuucauguucuacggcaucuuccuguaccugggcgaggugaccaaggccgugcaaccccugcugcucgggaggaucauagccuccuacgaccccgacaacaaggaagagaggagcauugccaucuaccugggcaucggccugugccugcuguucaucgugaggacacugcugcugcaccccgccaucuuuggacuccaccacaucggcaugcagaugaggaucgccauguucucccuuaucuacaagaaaacccugaagcucagcagcagggugcuggacaagaucagcaucggccagcucgugagccuccugagcaauaaccugaacaaguucgacgaaggccucgcccuagcccacuucguguggaucgcgccccugcagguggcccuccugaugggccugaucugggagcugcugcaagccuccgccuucugcggccucggcuuucugaucgugcucgcccuuuuccaagccggccucgggcgcaugaugaugaaguacagggaccagcgcgccggcaagaucagcgagaggcuugugaucaccagcgagaugaucgagaacauccagucugucaaagccuacugcugggaggaggccauggagaagaugaucgagaaccugaggcagacugagcucaagcugaccaggaaggccgccuacgugagguacuucaacucaucggccuucuucuucagcggcuucuucgugguguuucucagcguccugccguacgcucugaucaagggcauuauccugcggaagaucuucaccaccaucagcuucugcaucgugcuccggauggccgugacgaggcaguuccccugggccgugcagaccugguacgacagccugggcgccaucaauaaaauccaggacuuucuccagaagcaggaguacaaaacccucgaguacaaccugaccaccaccgaggucgugauggagaacgugaccgccuucugggaggagggcuucggcgagcuguucgaaaaggccaagcagaacaauaauaaccggaagaccagcaacggcgacgacucccucuucuucagcaauuucucccuccugggcacccccgugcucaaggacaucaauuuuaagaucgagaggggccagcugcuggccguggccggcuccaccggcgccggcaaaaccucccugcucauggugaucaugggggagcucgagccuagcgagggcaagaucaaacacagcggcaggaucucguucuguagccaguucagcuggaucaugcccggcaccauuaaagagaacaucaucuucggcguguccuaugacgaguacagguacaggagcgugauaaaagccugccagcuggaagaagacaucuccaaauucgccgagaaggacaauaucgugcucggugagggcggcaucacgcugagcggaggccagagggcccggaucucgcucgccagggccguguauaaggacgcggaccuguaucugcuggacagccccuuuggcuaccuggacgugcugaccgagaaagagaucuuugagagcugcgucugcaagcucauggccaacaagaccagaauccuggugaccagcaagauggaacaucugaagaaggccgacaagauucucauccugcacgagggguccagcuacuucuaugggaccuucuccgagcugcagaaccugcaacccgacuucagcagcaagcugaugggaugcgacucauucgaucaauucagcgccgagcggaggaacuccauccugaccgaaacacuccaucgguuuagccuggagggcgacgcacccgucuccuggaccgaaaccaagaaacagagcuucaagcagaccggcgaguuuggggagaagcgaaagaacuccauccucaacccgaucaacagcauccggaaguuuagcaucgugcagaagacaccccugcagaugaacggcaucgaggaggacagcgacgagccacuggagaggcgacugagccuggugccggacagcgagcagggggaagccauccugccaaggaucuccgugaucagcaccgggcccacccugcaggccaggcggaggcaaucgguccucaaucugaugacccacagcgucaaccaagggcaaaacauccaccggaagaccacagcgagcacccgaaaggugucccuggccccccaggccaaccugaccgagcuggacaucuacagccgcaggcugagccaggagaccggccuggagaucagcgaggagaucaacgaggaggaccugaaggagugcuuuuuugacgauauggagagcaucccugccgugaccaccuggaacaccuacuugcguuacauaaccgugcacaagagccugaucuucguccugaucuggugccuggugaucuuccuggccgagguggccgccagccucgugguccucuggcugcuggggaauaccccccugcaagacaagggaaacucuacccauagccgcaacaauagcuacgcggucauaauaaccuccaccagcagcuacuacguguuuuauaucuaugugggaguggccgacacccugcuggcaaugggcuucuucaggggccugccccuggugcacacccugaucaccguguccaagauccuccaucacaaaaugcuccacucgguccugcaggcgcccaugagcacgcugaacacccugaaggccggcggcauacugaaccgcuucagcaaggacaucgccauccuggaugaccuucucccccucaccaucuucgacuucauccagcuccugcugaucgugaucggcgccaucgccgugguggccguccugcagcccuauaucuucguggcgaccgugcccgucaucgucgccuucaucaugcugcgagccuacuuccugcaaacgagccagcagcugaagcagcuggaaagcgagggccgcagccccaucuucacccaccuggugaccagccuaaagggccuguggacccucagggccuuuggccgccagccuuacuucgaaacccuguuccacaaggcccugaaccuccacaccgccaacugguuccuguaccucuccacccugaggugguuccagaugcggaucgagaugaucuucgucaucuuuuucaucgccgugacguucaucagcauccugaccacgggcgagggggaaggccggguugguaucauccugacccuggccaugaacaucaugaguacacuccaaugggccgugaacuccagcaucgacguggacagccucaugaggagcgugagcaggguguuuaaguucauugacaugcccaccgaagggaaacccaccaagagcaccaagcccuacaagaacggucagcugagcaaggugaugauuaucgagaauucccacgugaagaaggacgacaucuggcccuccggaggccagaugaccgugaaggaccucaccgccaaauacacggagggcggcaacgccauccuggagaacaucagcuucuccaucucgcccggacagaggguuggccugcugggccggaccgggagcggcaaaucgacccuccugagcgccuuccugaggcuccucaacaccgagggcgagauccagaucgacggaguaagcugggacuccaucacgcugcagcaguggcgaaaggcguucgggguaaucccucagaaggucuucaucuucagcggcacuuuccggaagaaucuggaccccuacgaacaguggagcgaccaggaaaucuggaagguggccgacgaggugggccuuaggagcgucaucgagcaguuccccgggaagcuggacuucguacugguggacgguggcugcgugcugagccacgggcacaagcaacugaugugucuggcccggucggugcuguccaaggcgaaaauccugcuccuggacgagcccagcgcccaucuggaucccgugaccuaccagaucauacgccggacccugaagcaggccuucgccgacugcaccguaauacugugcgagcaccggaucgaggccaugcuggagugccagcaguuccucgugaucgaggagaacaagguaaggcaauaugacagcauccaaaaacugcuuaaugaaaggagccucuucaggcaggccaucucccccuccgaccgagugaaacuguucccccauagaaauagcagcaaaugcaaauccaagccccaaaucgccgcccugaaggaggagacggaggaggaggugcaagacacccggcug

SEQ ID NO: 130 - RNA, 4440 nt, Artificial Sequence
  Synthetic polynucleotide
augcagaggagcccccuggagaaggccagcgucgucagcaagcucuucuucagcuggacgaggcccauccuccggaaggguuaccggcagcggcuggagcuguccgacaucuaccagauacccuccguggacagcgccgauaaccugagcgaaaagcuggaaagggaaugggaccgggagcucgccuccaagaagaaccccaagcugauuaacgcccugcggcggugcuucuucuggcgcuucauguuuuacggcaucuuccuguaccugggugaggugaccaaggccgugcagccccugcugcucgggaggaucaucgcguccuacgaccccgacaacaaggaggagcgaagcaucgccaucuaucuggggaucgggcugugccugcuuuucaucguccgaacacugcugcugcaccccgcgaucuucgggcugcaccauauuggcaugcagaugaggauagccauguucagccugaucuauaaaaagacccugaaacugagcuccagggugcucgacaagaucagcaucggccagcuggugagccuccuguccaacaaccucaacaaguucgacgagggccucgcccuggcccacuuuguguggauugccccccugcagguggcgcugcugauggggcugaucugggagcugcugcaggccagcgcuuucugcggucuaggguuccucaucgugcuggcccucuuccaggccgggcuggggcguaugaugaugaaguaccgggaccagagggcgggcaagauaagcgagcgccuggugaucacguccgaaaugaucgagaacauccagucggucaaggccuacuguugggaggaagccauggagaagaugaucgagaaccugcgccaaaccgaacugaagcugaccaggaaggccgccuacguccgguauuucaacuccuccgcauucuuuuucuccggcuucuucgugguguuccugagcgugcugcccuaugcccugaucaaggggaucauccugaggaagaucuucaccacgaucagcuucugcaucgugcucaggauggcggucaccaggcaguuccccugggccguucagacaugguacgacagccugggggccaucaacaagauccaggauuuccugcagaaacaggaauauaagacccuggaguacaaccugaccaccacagaggucgugauggagaacgugaccgccuuuugggaggaaggcuuuggggaacuguucgagaaagccaaacagaacaauaacaacaggaagaccagcaacggggaugacucccucuucuucuccaacuucagccuccuggggacacccguccugaaggauaucaauuucaagaucgagcgcggccaacuccuggccguggccggcagcaccggugccgguaagaccagccugcugauggucaucaugggcgagcuggagccgagcgaaggcaagaucaaacacaguggccggaucagcuuuugcagccaguucuccuggauuaugcccggcaccaucaaagagaacaucauuuuuggugucuccuacgaugaguaucgcuaccggagcgugaucaaggccugccagcuggaggaggacaucucgaaguuugccgaaaaggacaacauuguccugggugaaggagggauuacccugagcgggggccagagggcccggaucagccuggcccgcgccgucuacaaggacgccgaccuguaccugcuggacagccccuucggauaccuggacgugcugaccgagaaggagaucuucgagagcugcgucugcaagcugauggccaacaagaccaggauccuggugaccagcaaaauggaacaccucaagaaagcggacaagauccugauacugcacgagggcagcucguacuucuacggcaccuucagcgagcugcagaaccugcagcccgacuucucuagcaagcugauggguugcgauuccuucgaccaguucagcgccgagaggcggaacuccauccugaccgagacccugcaucgguucucccuggagggcgacgcccccgugagcuggacugaaaccaaaaagcagagcuucaagcagacgggagaauucggcgagaagaggaagaacucgauucugaaccccaucaacagcauccggaaguucuccaucgugcagaagaccccccugcagaugaacgggaucgaagaggacucugaugagccccuggagaggaggcugagccucgugcccgacuccgagcagggcgaggccauacugccccguaucagcgugaucagcaccggccccacccugcaagcccgcaggaggcagucggugcugaaccucaugacgcacagcgugaaucagggccagaacauccacaggaaaacaacugcgagcacccgcaaggugagccuggcgccccaggccaaccugaccgagcucgacaucuauagccgucggcugagccaggagaccggccuggagaucagcgaggagauuaaugaggaggaccucaaggaaugcuucuucgacgacauggagagcauccccgcggugaccaccuggaacaccuaucugagguacauaaccgugcacaaaucccugaucuucguccugaucuggugccuggugaucuuccucgccgaggucgccgcgagccucgucgugcuguggcugcugggcaacaccccccugcaggacaagggcaacagcacccauagccgaaauaacucuuaugccgugaucaucaccagcaccucgagcuauuacgucuucuacaucuauguggggguggccgacacgcuucuggcaaugggcuucuucagaggacugccccuagugcacacgcugauaaccgugagcaagauccugcaccauaagaugcugcacuccgugcuccaggcccccaugagcacacucaacacccucaaagcaggcggcauccugaaucgguuuagcaaggacaucgccauacuggacgaucugcugccccucaccaucuucgacuucauccagcuccugcugaucgugaucggcgccaucgccgugguggccguguuacagcccuauaucuucguggcgaccgugccggugaucguggccuucaucaugcucagggccuacuuucugcagacgagccagcagcugaagcagcucgagagcgagggcaggucccccaucuucacacaccuggugaccagccugaaaggccuguggacccugagggccuuuggcaggcaacccuacuucgaaacacucuuucacaaagcccucaaucugcacaccgcgaacugguuccuguaccuguccacccugaggugguuccagaugaggaucgagaugaucuucgugaucuucuuuaucgccgucaccuucaucuccauccugaccaccggcgaaggcgagggccgggugggcaucauccugacccucgccaugaacaucaugagcacccugcagugggcggugaacagcuccaucgacguggauucccugaugagauccgugagccggguguucaaauucaucgacaugcccaccgaggggaagcccaccaagagcacgaagcccuacaagaacggccaacugagcaaggugaugaucaucgagaauucucacgugaagaaggacgacaucuggcccagcggcggacagaugaccgugaaagaccugaccgccaaguacacugagggcgggaacgccauccuugagaacauaagcuucagcaucagccccggucagagggugggccuccugggccggacgggcagcgggaaguccacccugcuguccgccuuccugcggcugcucaacaccgagggcgagauccagauagauggcguaagcugggacagcaucacccugcagcaauggcguaaggcguucggcgugauaccgcagaagguauucaucuucagcgggaccuucaggaagaaccucgaccccuacgagcaguggucggaccaggagaucuggaagguggccgacgaggucggccugcgcuccgucaucgagcaguuucccggaaaacuggacuuuguccugguggacggagguugcgugcugucucacggucacaagcagcugaugugucuggcccgcuccgugcugagcaaggccaagauccugcuucuggacgagcccagcgcccaccuggaccccgugaccuaccaaaucauccgccgcacccugaagcaggccuucgccgacuguaccgugauacugugcgagcaccgcaucgaggccaugcuggagugucagcaguuccuggugaucgaggagaacaaggugaggcaguaugacuccauccagaagcugcugaacgagagaagccuguucaggcaggccaucagccccuccgacagggugaagcuguucccccaucggaacagcagcaaguguaagagcaagccgcagaucgccgcccucaaagaggagaccgaggaagaagugcaggacacgcgucug

SEQ ID NO: 131 - RNA, 4440 nt, Artificial Sequence; identical to SEQ ID NO: 106
  Synthetic polynucleotide

SEQ ID NO: 132 - RNA, 4440 nt, Artificial Sequence; identical to SEQ ID NO: 107
  Synthetic polynucleotide

SEQ ID NO: 133 - RNA, 4440 nt, Artificial Sequence; identical to SEQ ID NO: 108
  Synthetic polynucleotide

SEQ ID NO: 134 - RNA, 4440 nt, Artificial Sequence; identical to SEQ ID NO: 109
  Synthetic polynucleotide

SEQ ID NO: 135 - RNA, 4440 nt, Artificial Sequence; identical to SEQ ID NO: 110
  Synthetic polynucleotide

SEQ ID NO: 136 - RNA, 4440 nt, Artificial Sequence; identical to SEQ ID NO: 111
  Synthetic polynucleotide

SEQ ID NO: 137 - RNA, 4440 nt, Artificial Sequence; identical to SEQ ID NO: 112
  Synthetic polynucleotide

SEQ ID NO: 138 - RNA, 4440 nt, Artificial Sequence; identical to SEQ ID NO: 113
  Synthetic polynucleotide

SEQ ID NO: 139 - RNA, 4440 nt, Artificial Sequence; identical to SEQ ID NO: 114
  Synthetic polynucleotide

SEQ ID NO: 140 - RNA, 4440 nt, Artificial Sequence; identical to SEQ ID NO: 115
  Synthetic polynucleotide

SEQ ID NO: 141 - RNA, 4440 nt, Artificial Sequence; identical to SEQ ID NO: 116
  Synthetic polynucleotide

SEQ ID NO: 142 - RNA, 4440 nt, Artificial Sequence; identical to SEQ ID NO: 117
  Synthetic polynucleotide

SEQ ID NO: 143 - RNA, 4440 nt, Artificial Sequence; identical to SEQ ID NO: 118
  Synthetic polynucleotide

SEQ ID NO: 144 - RNA, 4440 nt, Artificial Sequence; identical to SEQ ID NO: 119
  Synthetic polynucleotide

SEQ ID NO: 145 - RNA, 4440 nt, Artificial Sequence; identical to SEQ ID NO: 120
  Synthetic polynucleotide

SEQ ID NO: 146 - RNA, 4440 nt, Artificial Sequence; identical to SEQ ID NO: 121
  Synthetic polynucleotide

SEQ ID NO: 147 - RNA, 4440 nt, Artificial Sequence; identical to SEQ ID NO: 122
  Synthetic polynucleotide

SEQ ID NO: 148 - RNA, 4440 nt, Artificial Sequence; identical to SEQ ID NO: 123
  Synthetic polynucleotide

SEQ ID NO: 149 - RNA, 4440 nt, Artificial Sequence; identical to SEQ ID NO: 124
  Synthetic polynucleotide

SEQ ID NO: 150 - RNA, 4440 nt, Artificial Sequence; identical to SEQ ID NO: 125
  Synthetic polynucleotide

SEQ ID NO: 151 - RNA, 4440 nt, Artificial Sequence; identical to SEQ ID NO: 126
  Synthetic polynucleotide

SEQ ID NO: 152 - RNA, 4440 nt, Artificial Sequence; identical to SEQ ID NO: 127
  Synthetic polynucleotide

SEQ ID NO: 153 - RNA, 4440 nt, Artificial Sequence; identical to SEQ ID NO: 128
  Synthetic polynucleotide

SEQ ID NO: 154 - RNA, 4440 nt, Artificial Sequence; identical to SEQ ID NO: 129
  Synthetic polynucleotide

SEQ ID NO: 155 - RNA, 4440 nt, Artificial Sequence; identical to SEQ ID NO: 130
  Synthetic polynucleotide

SEQ ID NO: 156 - RNA, 142 nt, Artificial Sequence
  Synthetic polynucleotide
ugauaauaggcuggagccucgguggccuagcuucuugccccuugggccuccccccagccccuccuccccuuccugcacccguacccccuccauaaaguaggaaacacuacaguggucuuugaauaaagucugagugggcggc

SEQ ID NO: 157 - RNA, 141 nt, Artificial Sequence
  Synthetic polynucleotide
ugauaauaggcuggagccucgguggccuagcuucuugccccuugggccuccccccagccccuccuccccuuccugcacccguaccccccgcauuauuacucacgguacgaguggucuuugaauaaagucugagugggcggc

SEQ ID NO: 158 - RNA, 164 nt, Artificial Sequence
  Synthetic polynucleotide
ugauaauaguccauaaaguaggaaacacuacagcuggagccucgguggccuagcuucuugccccuugggccuccccccagccccuccuccccuuccugcacccguaccccccgcauuauuacucacgguacgaguggucuuugaauaaagucugagugggcggc

SEQ ID NO: 159 - RNA, 188 nt, Artificial Sequence
  Synthetic polynucleotide
ugauaauaguccauaaaguaggaaacacuacagcuggagccucgguggccuagcuucuugccccuugggccuccauaaaguaggaaacacuacauccccccagccccuccuccccuuccugcacccguacccccuccauaaaguaggaaacacuacaguggucuuugaauaaagucugagugggcggc

SEQ ID NO: 160 - RNA, 140 nt, Artificial Sequence
  Synthetic polynucleotide
ugauaauaggcuggagccucgguggccaugcuucuugccccuugggccuccccccagccccuccuccccuuccugcacccguacccccaguagugcuuucuacuuuaugguggucuuugaauaaagucugagugggcggc

SEQ ID NO: 161 - RNA, 181 nt, Artificial Sequence
  Synthetic polynucleotide
ugauaauagaguagugcuuucuacuuuauggcuggagccucgguggccaugcuucuugccccuugggccaguagugcuuucuacuuuauguccccccagccccucuccccuuccugcacccguacccccaguagugcuuucuacuuuaugguggucuuugaauaaagucugagugggcggc

SEQ ID NO: 162 - RNA, 184 nt, Artificial Sequence
  Synthetic polynucleotide
ugauaauagaguagugcuuucuacuuuauggcuggagccucgguggccaugcuucuugccccuugggccuccauaaaguaggaaacacuacauccccccagccccuccuccccuuccugcacccguacccccaguagugcuuucuacuuuaugguggucuuugaauaaagucugagugggcggc

SEQ ID NO: 163 - RNA, 142 nt, Artificial Sequence
  Synthetic polynucleotide
ugauaauaguccauaaaguaggaaacacuacagcuggagccucgguggccuagcuucuugccccuugggccuccccccagccccuccuccccuuccugcacccguacccccguggucuuugaauaaagucugagugggcggc

SEQ ID NO: 164 - RNA, 142 nt, Artificial Sequence
  Synthetic polynucleotide
ugauaauaggcuggagccucgguggcuccauaaaguaggaaacacuacacuagcuucuugccccuugggccuccccccagccccuccuccccuuccugcacccguacccccguggucuuugaauaaagucugagugggcggc

SEQ ID NO: 165 - RNA, 142 nt, Artificial Sequence
  Synthetic polynucleotide
ugauaauaggcuggagccucgguggccuagcuucuugccccuugggccuccauaaaguaggaaacacuacauccccccagccccuccuccccuuccugcacccguacccccguggucuuugaauaaagucugagugggcggc

SEQ ID NO: 166 - RNA, 142 nt, Artificial Sequence
  Synthetic polynucleotide
ugauaauaggcuggagccucgguggccuagcuucuugccccuugggccuccccccagccccuccuccccuuccugcacccguacccccaccccuaucacaauuagcauuaaguggucuuugaauaaagucugagugggcggc

SEQ ID NO: 167 - RNA, 188 nt, Artificial Sequence
  Synthetic polynucleotide
ugauaauagaccccuaucacaauuagcauuaagcuggagccucgguggccuagcuucuugccccuugggccaccccuaucacaauuagcauuaauccccccagccccuccuccccuuccugcacccguacccccaccccuaucacaauuagcauuaaguggucuuugaauaaagucugagugggcggc

SEQ ID NO: 168 - RNA, 188 nt, Artificial Sequence
  Synthetic polynucleotide
ugauaauagaccccuaucacaauuagcauuaagcuggagccucgguggccuagcuucuugccccuugggccuccauaaaguaggaaacacuacauccccccagccccuccuccccuuccugcacccguacccccaccccuaucacaauuagcauuaaguggucuuugaauaaagucugagugggcggc

What is claimed is:

1. A pharmaceutical composition comprising a lipid nanoparticle, wherein the lipid nanoparticle comprises a compound selected from the group consisting of

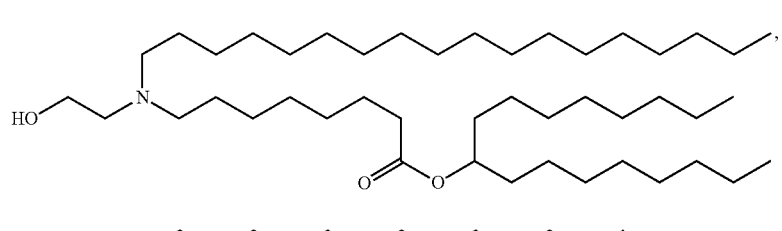

(Compound 1)

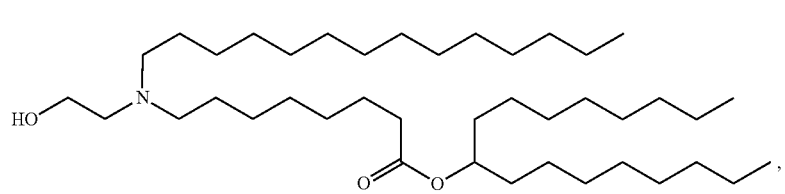

(Compound 2)

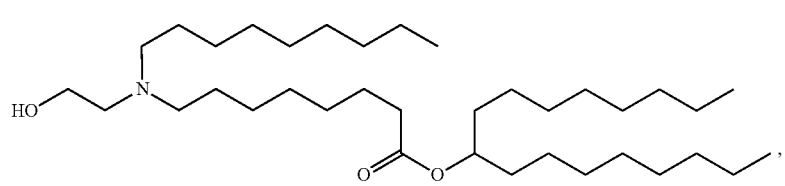

(Compound 3)

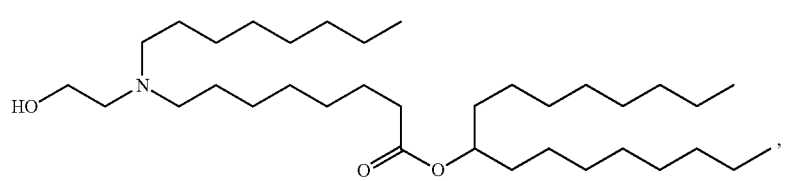

(Compound 4)

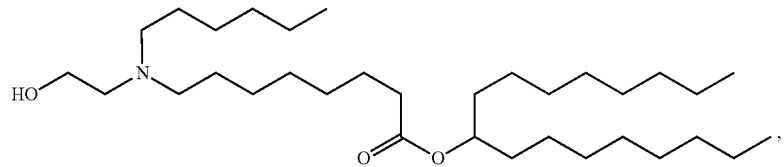
(Compound 5)
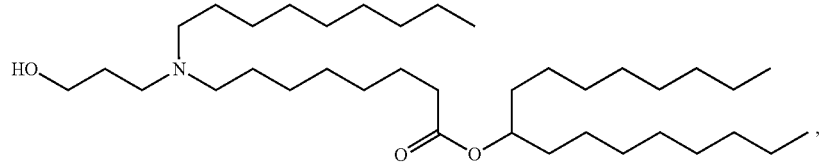
(Compound 7)
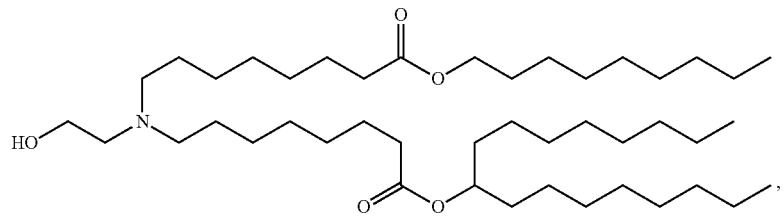
(Compound 18)
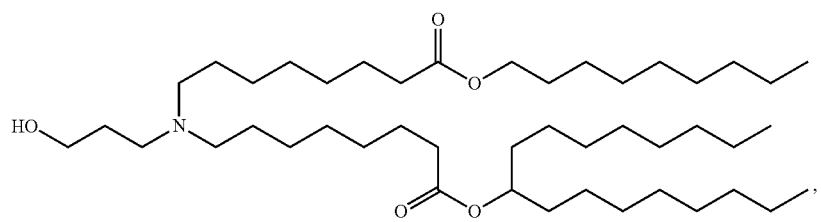
(Compound 19)
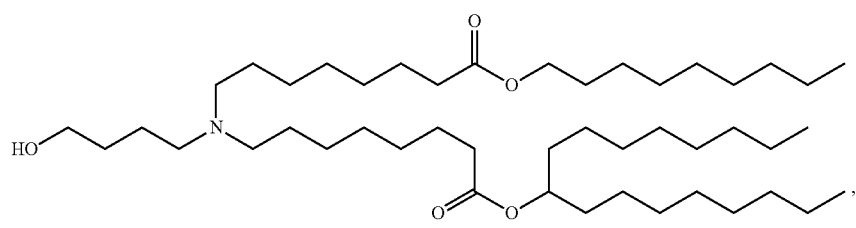
(Compound 20)
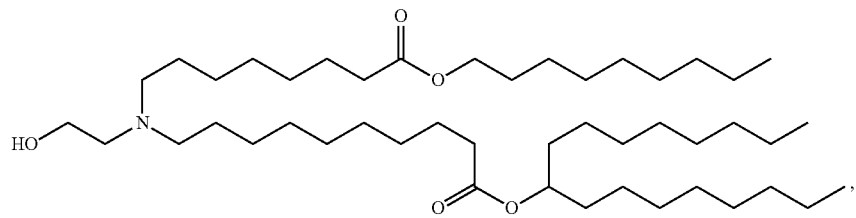
(Compound 23)
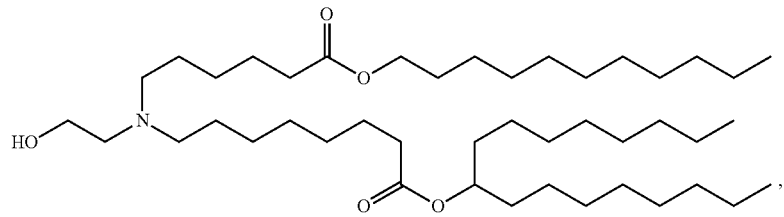
(Compound 25)

-continued
(Compound 26)
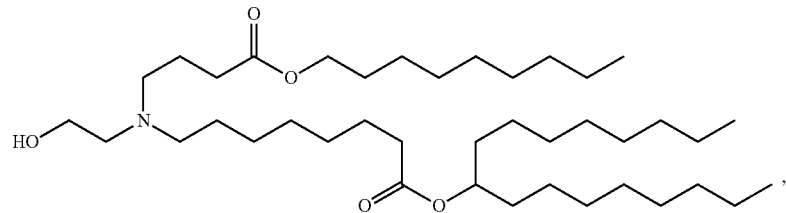
(Compound 27)
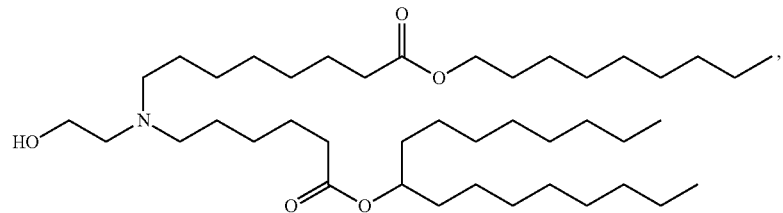
(Compound 30)
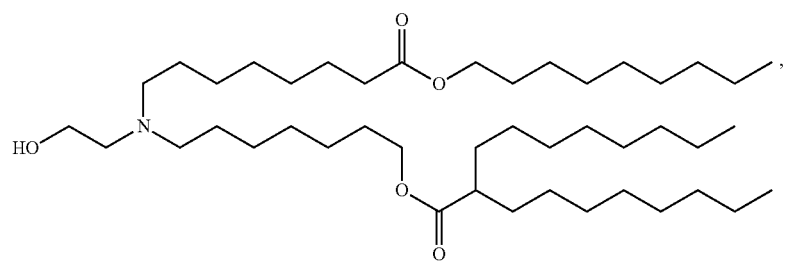
(Compound 32)
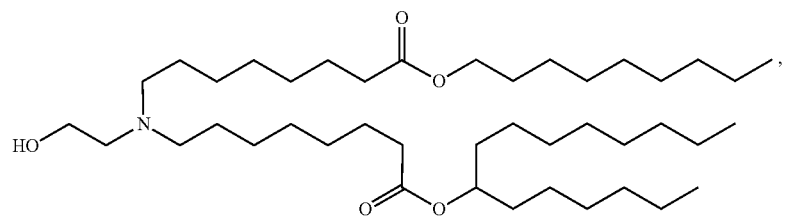
(Compound 33)
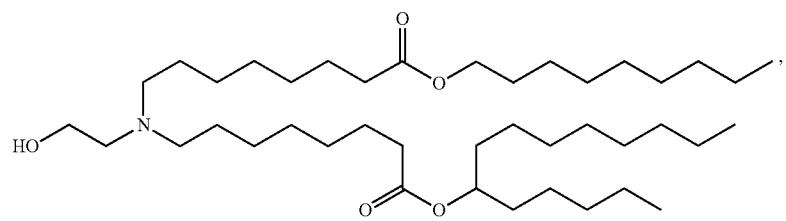
(Compound 34)
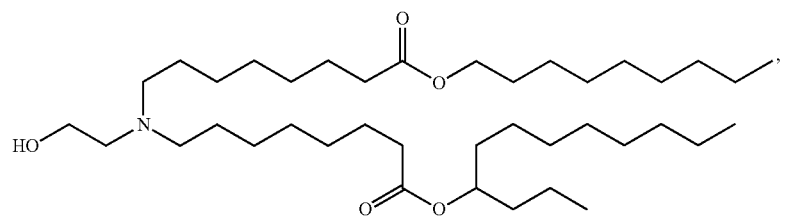
(Compound 35)
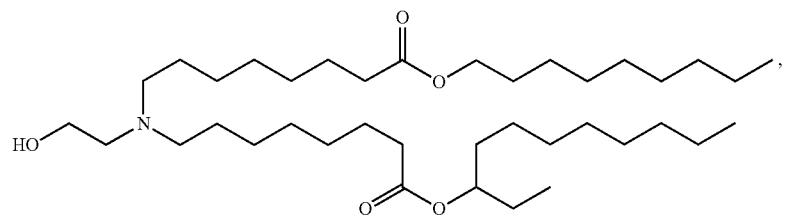

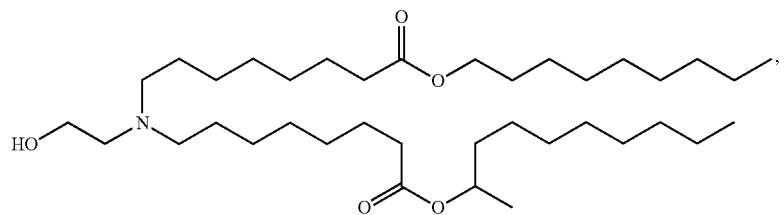
(Compound 36)
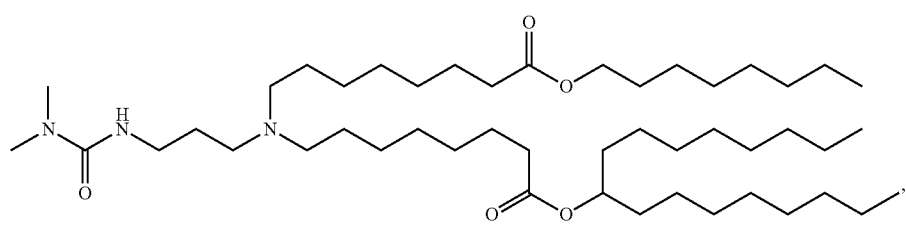
(Compound 39)
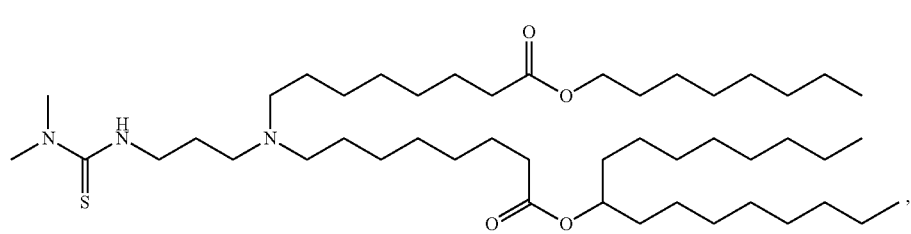
(Compound 40)
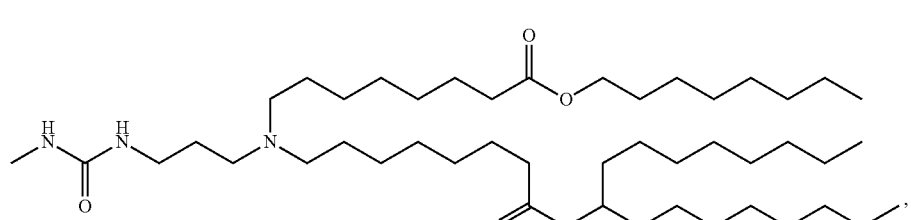
(Compound 41)
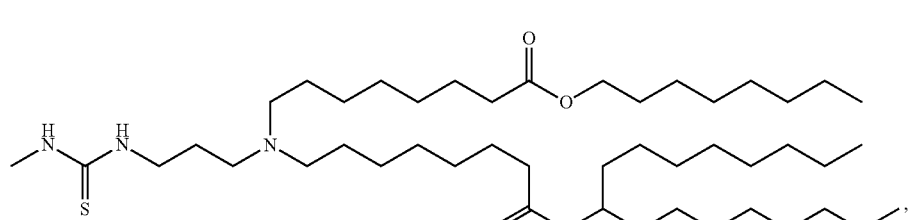
(Compound 42)
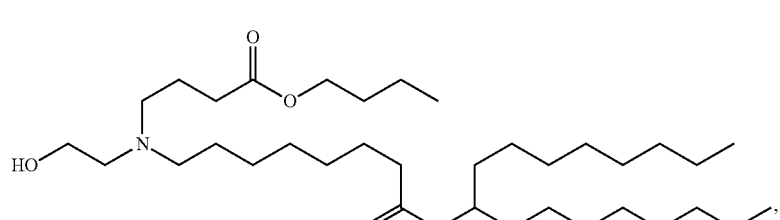
(Compound 51)
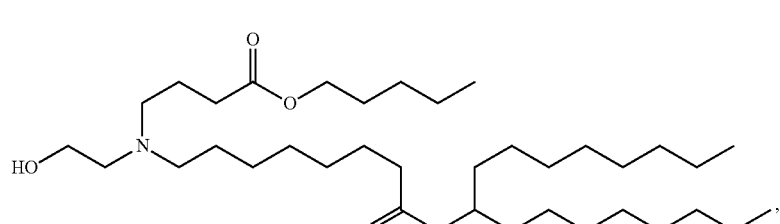
(Compound 52)

-continued
(Compound 53)
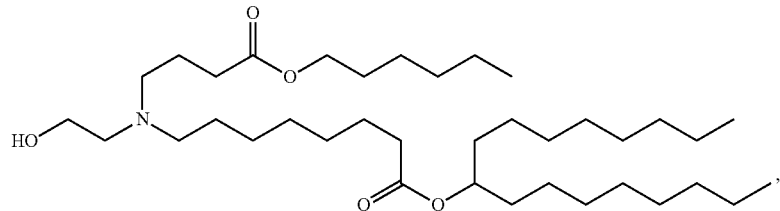
(Compound 54)
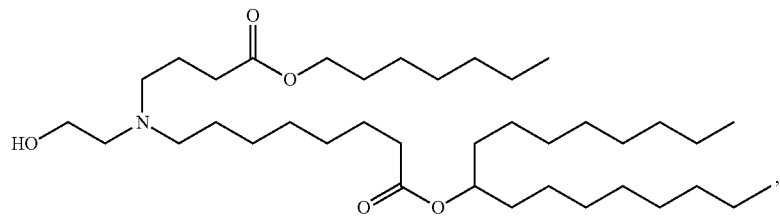
(Compound 56)
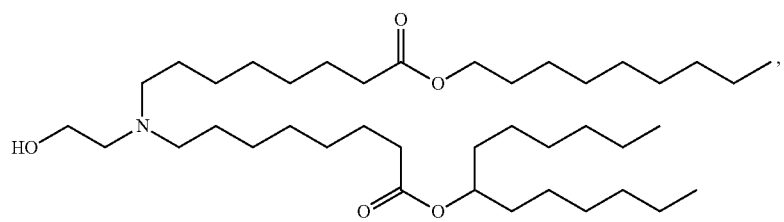
(Compound 57)
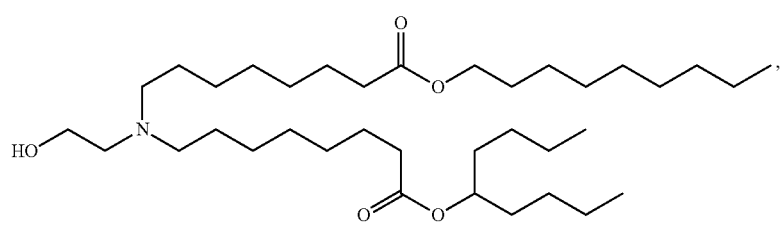
(Compound 58)
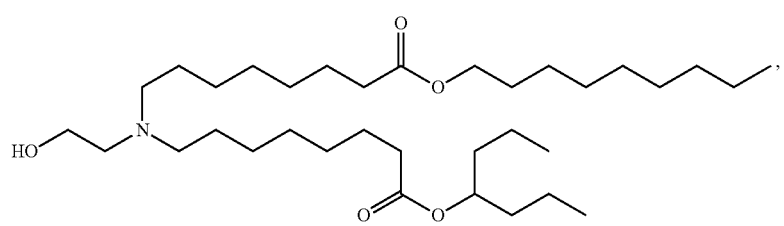
(Compound 59)
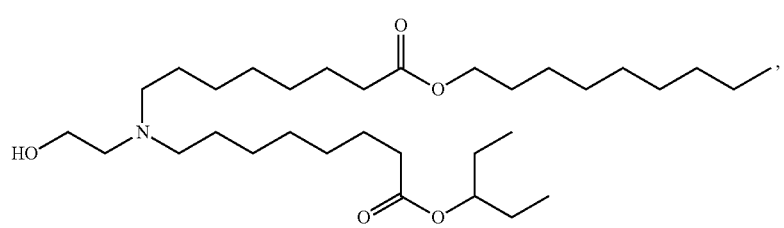
(Compound 60)
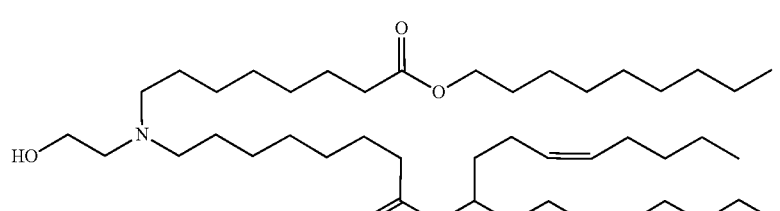

-continued
(Compound 61)
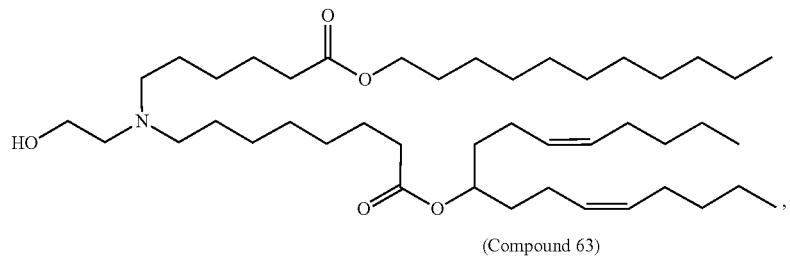
(Compound 63)
(Compound 64)
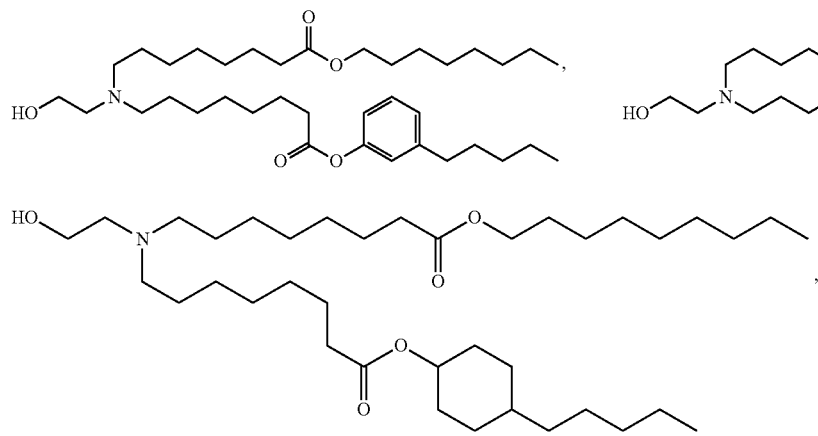
(Compound 79)
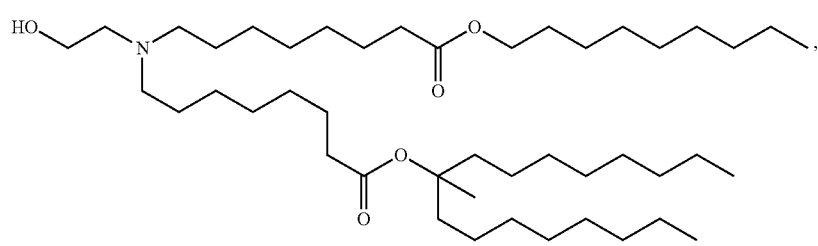
(Compound 82)
(Compound 96)
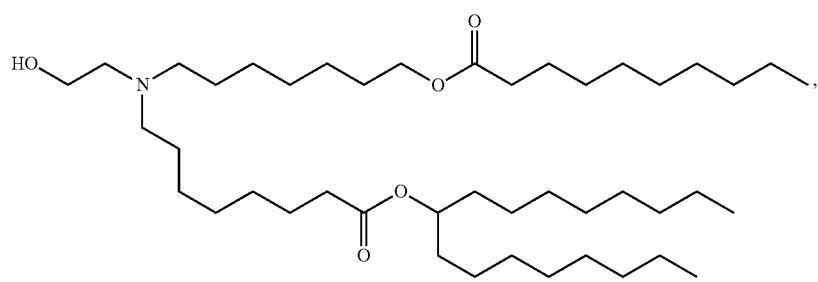
(Compound 97)
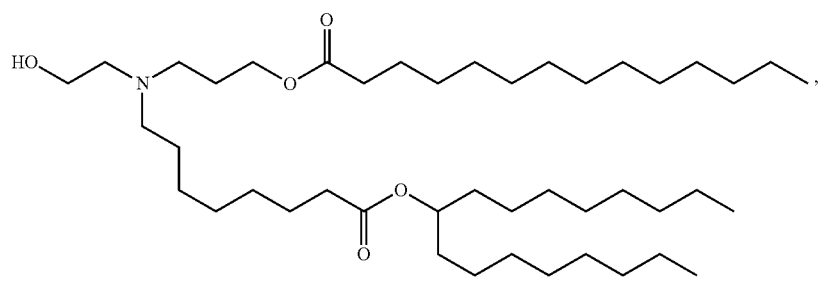

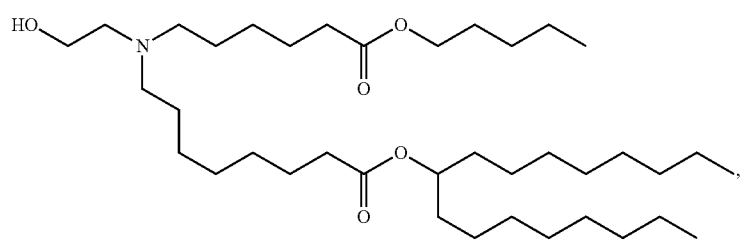
(Compound 104)
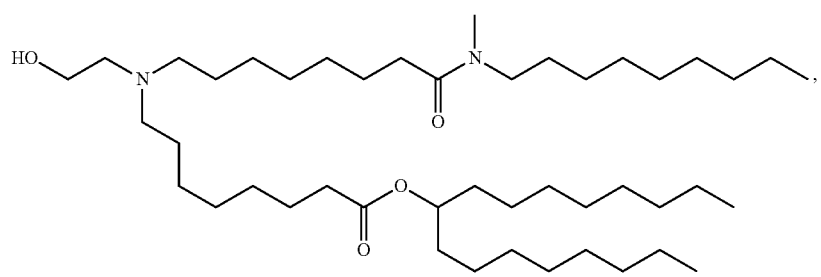
(Compound 105)
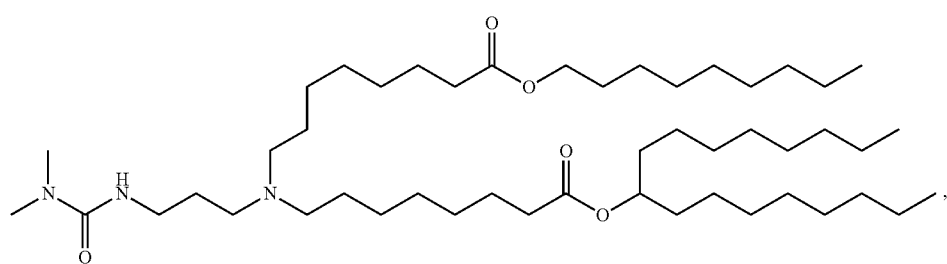
(Compound 110)
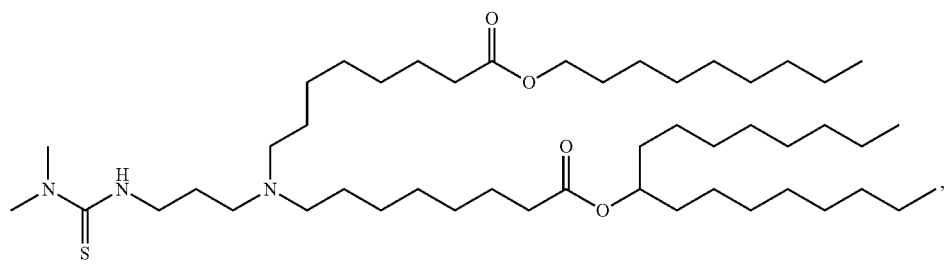
(Compound 111)
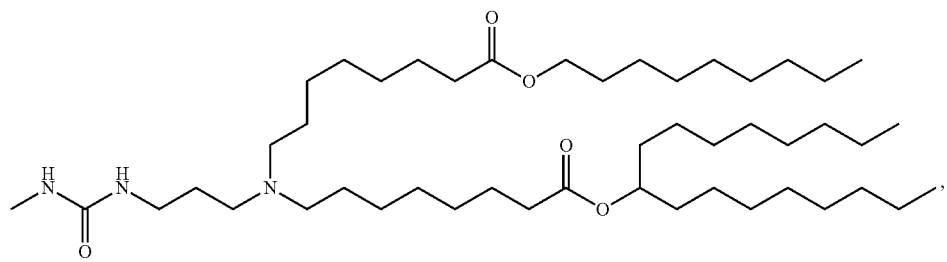
(Compound 112)
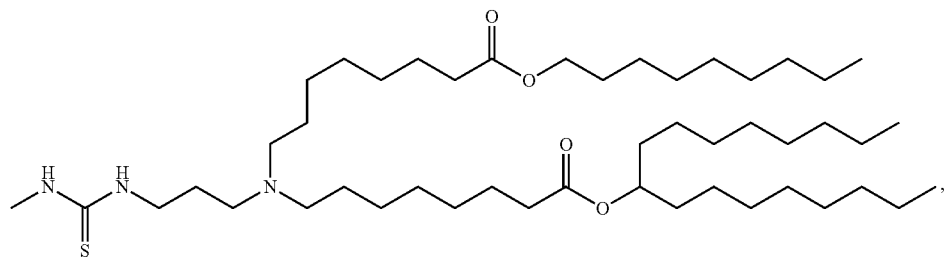
(Compound 113)

(Compound 119)
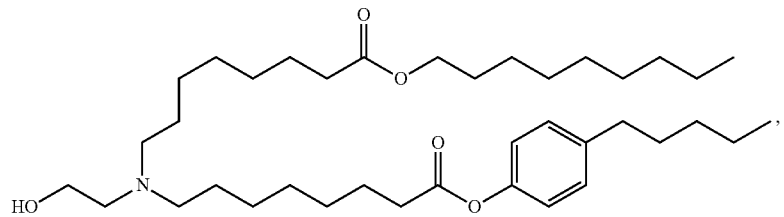
(Compound 120)
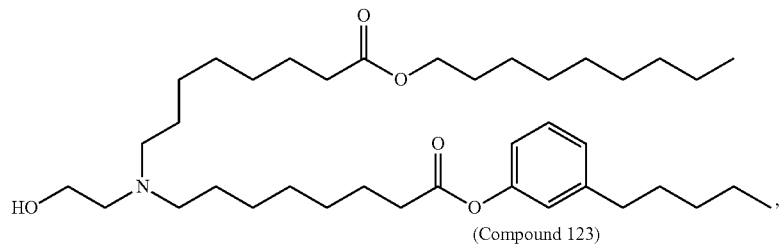
(Compound 123) (Compound 126)
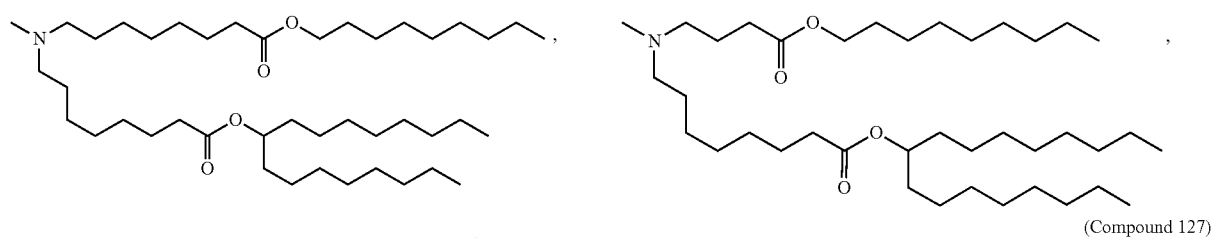
(Compound 127)
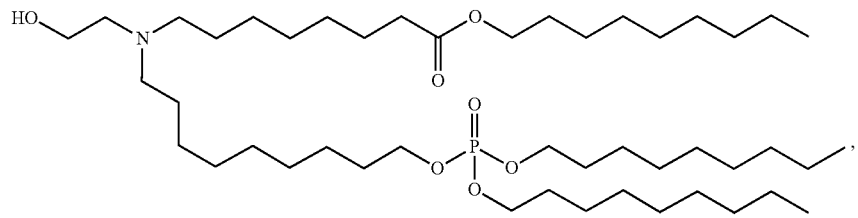
(Compound 129)
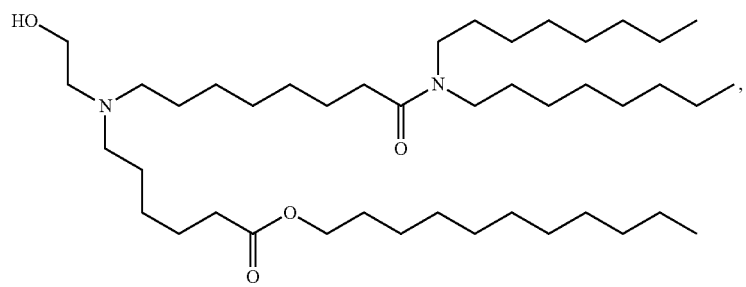
(Compound 131)
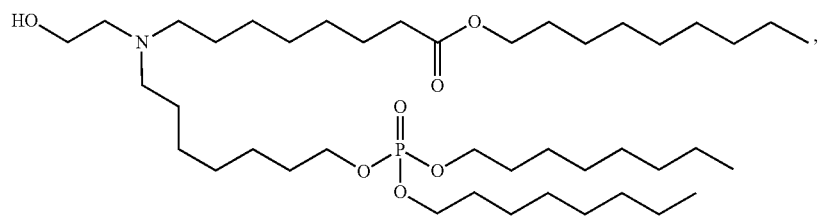
(Compound 134)
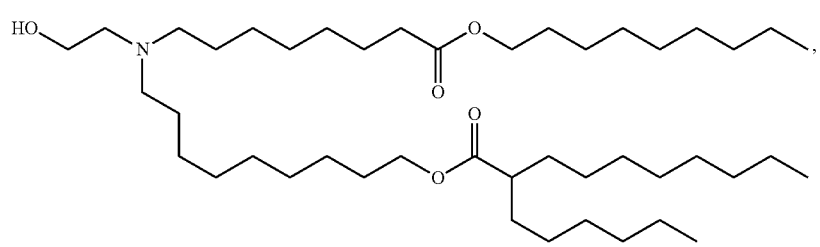

(Compound 137)
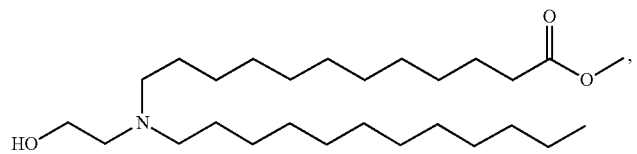
(Compound 138)
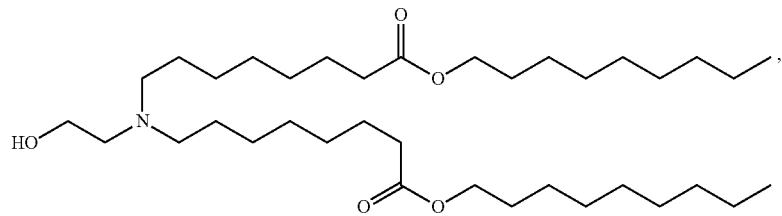
(Compound 141)
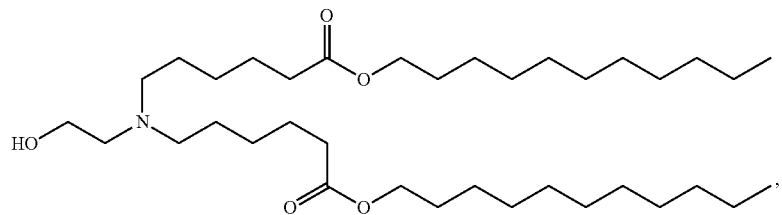
(Compound 142)
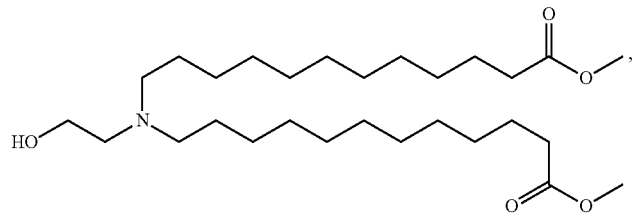
(Compound 143)
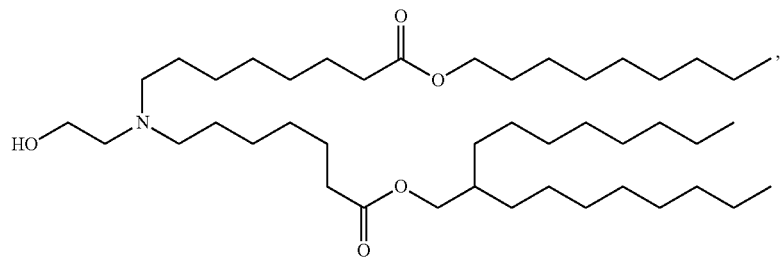
(Compound 144)
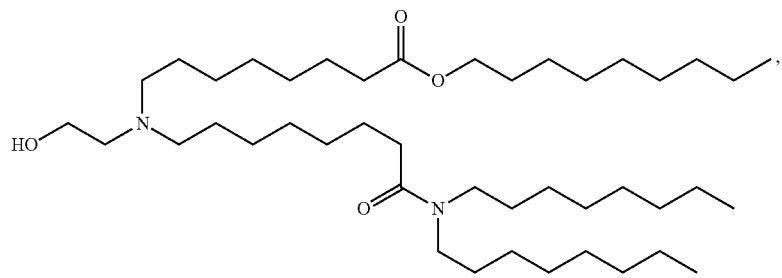
(Compound 145)
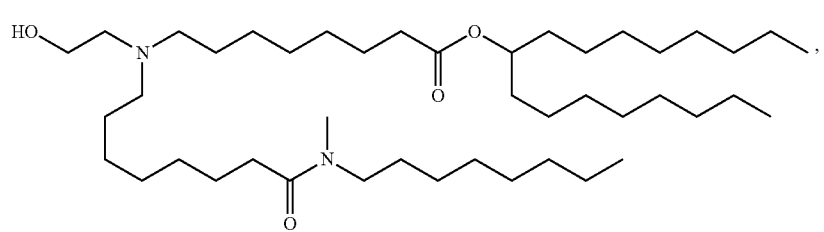

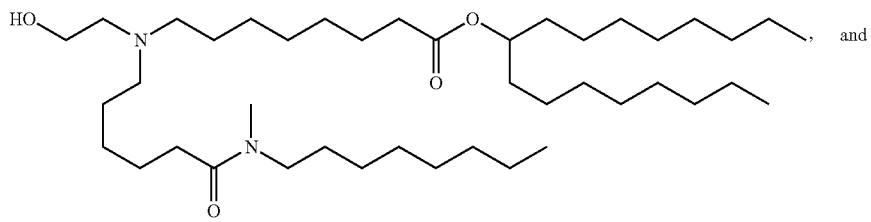

(Compound 146) and

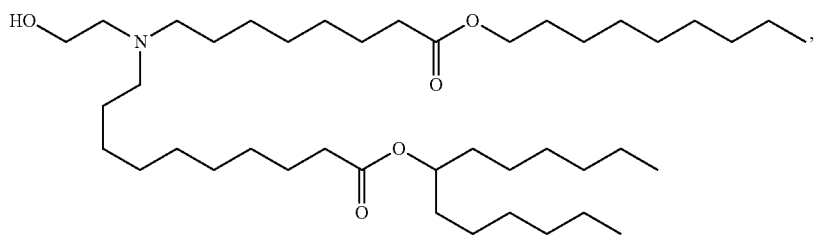

(Compound 147)

or salts and stereoisomers thereof,
wherein the lipid nanoparticle comprises an mRNA that comprises an open reading frame (ORF) encoding a cystic fibrosis transmembrane conductance regulator (CFTR) polypeptide.

2. The pharmaceutical composition of claim 1, wherein the lipid nanoparticle further comprises a phospholipid.

3. The pharmaceutical composition of claim 1, wherein the lipid nanoparticle further comprises a structural lipid.

4. The pharmaceutical composition of claim 1, wherein the lipid nanoparticle further comprises a polyethylene glycol lipid.

5. The pharmaceutical composition of claim 1, wherein the lipid nanoparticle further comprises a phospholipid, a structural lipid, and a polyethylene glycol lipid.

6. The pharmaceutical composition of claim 2, wherein the phospholipid is selected from the group consisting of:
1,2-dilinoleoyl-sn-glycero-3-phosphocholine (DLPC),
1,2-dimyristoyl-sn-glycero-phosphocholine (DMPC),
1,2-dioleoyl-sn-glycero-3-phosphocholine (DOPC),
1,2-dipalmitoyl-sn-glycero-3-phosphocholine (DPPC),
1,2-distearoyl-sn-glycero-3-phosphocholine (DSPC),
1,2-diundecanoyl-sn-glycero-phosphocholine (DUPC),
1-palmitoyl-2-oleoyl-sn-glycero-3-phosphocholine (POPC),
1,2-di-O-octadecenyl-sn-glycero-3-phosphocholine (18:0 Diether PC),
1-oleoyl-2-cholesterylhemisuccinoyl-sn-glycero-3-phosphocholine (OChemsPC),
1-hexadecyl-sn-glycero-3-phosphocholine (C16 Lyso PC),
1,2-dilinolenoyl-sn-glycero-3-phosphocholine,
1,2-diarachidonoyl-sn-glycero-3-phosphocholine,
1,2-didocosahexaenoyl-sn-glycero-3-phosphocholine,
1,2-dioleoyl-sn-glycero-3-phosphoethanolamine (DOPE),
1,2-diphytanoyl-sn-glycero-3-phosphoethanolamine (ME 16:0 PE),
1,2-distearoyl-sn-glycero-3-phosphoethanolamine,
1,2-dilinoleoyl-sn-glycero-3-phosphoethanolamine,
1,2-dilinolenoyl-sn-glycero-3-phosphoethanolamine,
1,2-diarachidonoyl-sn-glycero-3-phosphoethanolamine,
1,2-didocosahexaenoyl-sn-glycero-3-phosphoethanolamine,
1,2-dioleoyl-sn-glycero-3-phospho-rac-(1-glycerol) sodium salt (DOPG), and sphingomyelin.

7. The pharmaceutical composition of claim 3, wherein the structural lipid is selected from the group consisting of cholesterol, fecosterol, sitosterol, ergosterol, campesterol, stigmasterol, brassicasterol, tomatidine, ursolic acid, and alpha-tocopherol.

8. The pharmaceutical composition of claim 4, wherein the polyethylene glycol lipid is selected from the group consisting of a polyethylene glycol-modified phosphatidylethanolamine, a polyethylene glycol-modified phosphatidic acid, a polyethylene glycol-modified ceramide, a polyethylene glycol-modified dialkylamine, a polyethylene glycol-modified diacylglycerol, and a polyethylene glycol-modified dialkylglycerol.

9. The pharmaceutical composition of claim 5, wherein:
(i) the phospholipid is selected from the group consisting of
1,2-dilinoleoyl-sn-glycero-3-phosphocholine (DLPC),
1,2-dimyristoyl-sn-glycero-phosphocholine (DMPC),
1,2-dioleoyl-sn-glycero-3-phosphocholine (DOPC),
1,2-dipalmitoyl-sn-glycero-3-phosphocholine (DPPC),
1,2-distearoyl-sn-glycero-3-phosphocholine (DSPC),
1,2-diundecanoyl-sn-glycero-phosphocholine (DUPC),
1-palmitoyl-2-oleoyl-sn-glycero-3-phosphocholine (POPC),
1,2-di-O-octadecenyl-sn-glycero-3-phosphocholine (18:0 Diether PC),
1-oleoyl-2-cholesterylhemisuccinoyl-sn-glycero-3-phosphocholine (OChemsPC),
1-hexadecyl-sn-glycero-3-phosphocholine (C16 Lyso PC),
1,2-dilinolenoyl-sn-glycero-3-phosphocholine,
1,2-diarachidonoyl-sn-glycero-3-phosphocholine,
1,2-didocosahexaenoyl-sn-glycero-3-phosphocholine,
1,2-dioleoyl-sn-glycero-3-phosphoethanolamine (DOPE),
1,2-diphytanoyl-sn-glycero-3-phosphoethanolamine (ME 16:0 PE),
1,2-distearoyl-sn-glycero-3-phosphoethanolamine,
1,2-dilinoleoyl-sn-glycero-3-phosphoethanolamine,
1,2-dilinolenoyl-sn-glycero-3-phosphoethanolamine,
1,2-diarachidonoyl-sn-glycero-3-phosphoethanolamine,
1,2-didocosahexaenoyl-sn-glycero-3-phosphoethanolamine, 1,2-dioleoyl-sn-glycero-3-phospho-rac-(1-glycerol) sodium salt (DOPG), and sphingomyelin;

(ii) the structural lipid is selected from the group consisting of cholesterol, fecosterol, sitosterol, ergosterol, campesterol, stigmasterol, brassicasterol, tomatidine, ursolic acid, and alpha-tocopherol; and (iii) the polyethylene glycol lipid is selected from the group consisting of a polyethylene glycol-modified phosphatidylethanolamine, a polyethylene glycol-modified phosphatidic acid, a polyethylene glycol-modified ceramide, a polyethylene glycol-modified dialkylamine, a polyethylene glycol-modified diacylglycerol, and a polyethylene glycol-modified dialkylglycerol.

10. A method of expressing a CFTR polypeptide in a human subject that has cystic fibrosis comprising administering to the human subject an effective amount of the pharmaceutical composition of claim 1.

11. A method of treating cystic fibrosis in a human subject in need thereof, comprising administering to the human subject an effective amount of the pharmaceutical composition of claim 1.

12. A method of improving the measure of at least one respiratory volume in a human subject that has cystic fibrosis, comprising administering to the human subject an effective amount of the pharmaceutical composition of claim 1.

13. The method of claim 12, wherein the at least one respiratory volume is selected from the group consisting of tidal volume, inspiratory reserve volume, expiratory reserve volume, residual volume, vital capacity, and total lung capacity.

14. A method of reducing sweat gland secretion of chloride in a human subject that has cystic fibrosis, comprising administering to the human subject an effective amount of the pharmaceutical composition of claim 1.

15. A method of increasing the pH of airway secretions in a human subject that has cystic fibrosis, comprising administering to the human subject an effective amount of the pharmaceutical composition of claim 1.

16. A pharmaceutical composition comprising a lipid nanoparticle, wherein the lipid nanoparticle comprises Compound 18, (Compound 18)

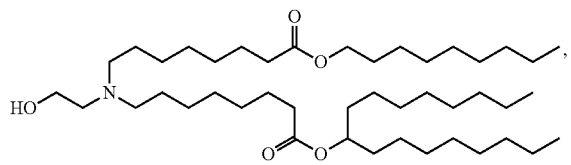

or a salt thereof,
wherein the lipid nanoparticle comprises an mRNA that comprises an open reading frame (ORF) encoding a cystic fibrosis transmembrane conductance regulator (CFTR) polypeptide.

17. The pharmaceutical composition of claim 16, wherein the lipid nanoparticle further comprises a phospholipid.

18. The pharmaceutical composition of claim 16, wherein the lipid nanoparticle further comprises a structural lipid.

19. The pharmaceutical composition of claim 16, wherein the lipid nanoparticle further comprises a polyethylene glycol lipid.

20. The pharmaceutical composition of claim 16, wherein the lipid nanoparticle further comprises a phospholipid, a structural lipid, and a polyethylene glycol lipid.

21. The pharmaceutical composition of claim 17, wherein the phospholipid is selected from the group consisting of
1,2-dilinoleoyl-sn-glycero-3-phosphocholine (DLPC),
1,2-dimyristoyl-sn-glycero-phosphocholine (DMPC),
1,2-dioleoyl-sn-glycero-3-phosphocholine (DOPC),
1,2-dipalmitoyl-sn-glycero-3-phosphocholine (DPPC),
1,2-distearoyl-sn-glycero-3-phosphocholine (DSPC),
1,2-diundecanoyl-sn-glycero-phosphocholine (DUPC),
1-palmitoyl-2-oleoyl-sn-glycero-3-phosphocholine (POPC),
1,2-di-O-octadecenyl-sn-glycero-3-phosphocholine (18:0 Diether PC),
1-oleoyl-2-cholesterylhemisuccinoyl-sn-glycero-3-phosphocholine (OChemsPC),
1-hexadecyl-sn-glycero-3-phosphocholine (C16 Lyso PC),
1,2-dilinolenoyl-sn-glycero-3-phosphocholine,
1,2-diarachidonoyl-sn-glycero-3-phosphocholine,
1,2-didocosahexaenoyl-sn-glycero-3-phosphocholine,
1,2-dioleoyl-sn-glycero-3-phosphoethanolamine (DOPE),
1,2-diphytanoyl-sn-glycero-3-phosphoethanolamine (ME 16:0 PE),
1,2-distearoyl-sn-glycero-3-phosphoethanolamine,
1,2-dilinoleoyl-sn-glycero-3-phosphoethanolamine,
1,2-dilinolenoyl-sn-glycero-3-phosphoethanolamine,
1,2-diarachidonoyl-sn-glycero-3-phosphoethanolamine,
1,2-didocosahexaenoyl-sn-glycero-3-phosphoethanolamine,
1,2-dioleoyl-sn-glycero-3-phospho-rac-(1-glycerol) sodium salt (DOPG), and sphingomyelin.

22. The pharmaceutical composition of claim 18, wherein the structural lipid is selected from the group consisting of cholesterol, fecosterol, sitosterol, ergosterol, campesterol, stigmasterol, brassicasterol, tomatidine, ursolic acid, and alpha-tocopherol.

23. The pharmaceutical composition of claim 19, wherein the polyethylene glycol lipid is selected from the group consisting of a polyethylene glycol-modified phosphatidylethanolamine, a polyethylene glycol-modified phosphatidic acid, a polyethylene glycol-modified ceramide, a polyethylene glycol-modified dialkylamine, a polyethylene glycol-modified diacylglycerol, and a polyethylene glycol-modified dialkylglycerol.

24. The pharmaceutical composition of claim 20, wherein:

(i) the phospholipid is selected from the group consisting of
1,2-dilinoleoyl-sn-glycero-3-phosphocholine (DLPC),
1,2-dimyristoyl-sn-glycero-phosphocholine (DMPC),
1,2-dioleoyl-sn-glycero-3-phosphocholine (DOPC),
1,2-dipalmitoyl-sn-glycero-3-phosphocholine (DPPC),
1,2-distearoyl-sn-glycero-3-phosphocholine (DSPC),
1,2-diundecanoyl-sn-glycero-phosphocholine (DUPC),
1-palmitoyl-2-oleoyl-sn-glycero-3-phosphocholine (POPC),
1,2-di-O-octadecenyl-sn-glycero-3-phosphocholine (18:0 Diether PC),
1-oleoyl-2-cholesterylhemisuccinoyl-sn-glycero-3-phosphocholine (OChemsPC),
1-hexadecyl-sn-glycero-3-phosphocholine (C16 Lyso PC),
1,2-dilinolenoyl-sn-glycero-3-phosphocholine,
1,2-diarachidonoyl-sn-glycero-3-phosphocholine, 1,2-didocosahexaenoyl-sn-glycero-3-phosphocholine,
1,2-dioleoyl-sn-glycero-3-phosphoethanolamine (DOPE),
1,2-diphytanoyl-sn-glycero-3-phosphoethanolamine (ME 16:0 PE),
1,2-distearoyl-sn-glycero-3-phosphoethanolamine,
1,2-dilinoleoyl-sn-glycero-3-phosphoethanolamine,
1,2-dilinolenoyl-sn-glycero-3-phosphoethanolamine,
1,2-diarachidonoyl-sn-glycero-3-phosphoethanolamine,
1,2-didocosahexaenoyl-sn-glycero-3-phosphoethanolamine,
1,2-dioleoyl-sn-glycero-3-phospho-rac-(1-glycerol) sodium salt (DOPG), and sphingomyelin;

(ii) the structural lipid is selected from the group consisting of cholesterol, fecosterol, sitosterol, ergosterol, campesterol, stigmasterol, brassicasterol, tomatidine, ursolic acid, and alpha-tocopherol; and (iii) the polyethylene glycol lipid is selected from the group consisting of a polyethylene glycol-modified phosphatidylethanolamine, a polyethylene glycol-modified phosphatidic acid, a polyethylene glycol-modified ceramide, a polyethylene glycol-modified dialkylamine, a polyethylene glycol-modified diacylglycerol, and a polyethylene glycol-modified dialkylglycerol.

25. A method of expressing a CFTR polypeptide in a human subject that has cystic fibrosis, comprising administering to the human subject an effective amount of the pharmaceutical composition of claim 16.

26. A method of treating cystic fibrosis in a human subject in need thereof, comprising administering to the human subject an effective amount of the pharmaceutical composition of claim 16.

27. A method of improving the measure of at least one respiratory volume in a human subject that has cystic fibrosis, comprising administering to the human subject an effective amount of the pharmaceutical composition of claim 16.

28. The method of claim 27, wherein the at least one respiratory volume is selected from the group consisting of tidal volume, inspiratory reserve volume, expiratory reserve volume, residual volume, vital capacity, and total lung capacity.

29. A method of reducing sweat gland secretion of chloride in a human subject that has cystic fibrosis, comprising administering to the human subject an effective amount of the pharmaceutical composition of claim 16.

30. A method of increasing the pH of airway secretions in a human subject that has cystic fibrosis, comprising administering to the human subject an effective amount of the pharmaceutical composition of claim 16.

* * * * *